(12) United States Patent
Nuccio

(10) Patent No.: US 9,187,756 B2
(45) Date of Patent: Nov. 17, 2015

(54) EXPRESSION CASSETTES DERIVED FROM MAIZE

(75) Inventor: Michael L. Nuccio, Durham, NC (US)

(73) Assignee: Syngenta Participations AG, Basel (CH)

( * ) Notice: Subject to any disclaimer, the term of this patent is extended or adjusted under 35 U.S.C. 154(b) by 679 days.

(21) Appl. No.: 13/377,170

(22) PCT Filed: Jun. 8, 2010

(86) PCT No.: PCT/US2010/037683
§ 371 (c)(1),
(2), (4) Date: Dec. 9, 2011

(87) PCT Pub. No.: WO2010/144385
PCT Pub. Date: Dec. 16, 2010

(65) Prior Publication Data
US 2012/0198584 A1 Aug. 2, 2012

Related U.S. Application Data

(60) Provisional application No. 60/186,038, filed on Jun. 11, 2009.

(51) Int. Cl.
*C12N 15/82* (2006.01)
*C07K 14/415* (2006.01)

(52) U.S. Cl.
CPC .......... *C12N 15/8216* (2013.01); *C07K 14/415* (2013.01)

(58) Field of Classification Search
None
See application file for complete search history.

(56) References Cited

U.S. PATENT DOCUMENTS

| 6,020,190 A | 2/2000 | Quail et al. |
| 2007/0006344 A1 | 1/2007 | Nuccio et al. |
| 2012/0159672 A1* | 6/2012 | Alexandrov et al. ......... 800/298 |

FOREIGN PATENT DOCUMENTS

WO 2005/102034 11/2005

OTHER PUBLICATIONS

Tijssen, Hybrid. Nucleic Acid Probes (Lab Tech Biochem Mol Biol v24, ed. var der Vliet), pp. 19-78 (1993).*
Dolferus__Plant Phys__105__1075__1994.*
Donald__EMBO J__9__1717__1990.*
Kim__Plant Mol Biol__24__105__1994.*
Merriam Webster DIctionary__Jul. 14, 2014.*
S94466 1993.*
Christensen__Plant Mol Biol__18__675__1992.*
Khan__Pak J Biol Sci__4__1518__2001.*
Christensen et al., Transgen Res 5:213-18 (1996).*
Potenza__In Vitro Cell Dev Biol Plant__40__1__2004.*
Fourgoux-Nicol Plant Mol Biol 40 857 1999.*
Toki et al., Plant Physiol, Nov. 1992, vol. 100, No. 3, pp. 1503-1507.
Christensen et al., Plant Mol Bio, Feb. 1992, vol. 18, No. 4, pp. 675-689.

* cited by examiner

*Primary Examiner* — Medina A Ibrahim
*Assistant Examiner* — Russell Boggs
(74) *Attorney, Agent, or Firm* — Yoshimi D. Barron

(57) ABSTRACT

The present invention includes expression cassettes that contain regulatory sequences derived from a target gene, for example, regulatory sequences from the HSP70, Ubi158, and Ubi361 genes, for expression of recombinant gene products in plants. Developmental expression profiling data were used to indentify several gene candidates for strong constitutive expression cassette development. Three expression cassettes were developed. They are based on the ZmHSP70, ZmUbi158, and ZmUBI361 genes.

19 Claims, No Drawings

EXPRESSION CASSETTES DERIVED FROM MAIZE

CROSS-REFERENCE TO RELATED APPLICATIONS

This application claims the benefit of U.S. Provisional Application No. 61/186,038, filed Jun. 11, 2009. The above application is incorporated herein by reference in its entirety.

FIELD OF THE INVENTION

The present invention includes expression cassettes that contain regulatory sequences derived from a target gene, for example, regulatory sequences from the HSP70, Ubi158, and Ubi361 genes, for expression of recombinant gene products in plants.

BACKGROUND

In agricultural biotechnology, plants can be modified according to one's needs. One way to accomplish this is by using modern genetic engineering techniques. For example, by introducing a gene of interest into a plant, the plant can be specifically modified to express a desirable phenotypic trait. For this, plants are transformed most commonly with a heterologous gene comprising a promoter region, a coding region and a termination region. When genetically engineering a heterologous gene for expression in plants, the selection of a promoter is often a critical factor.

Promoters consist of several regions that are necessary for function of the promoter. Some of these regions are modular composites, in other words they can be used in isolation to confer promoter activity or they may be assembled with other elements to construct new promoters (Komarnytsky and Borisjuk, Genetic Engineering 25: 113-141(2003)). The first of these promoter regions lies immediately upstream of the coding sequence and forms the "core promoter region" containing coupling elements, normally 20-70 base pairs immediately upstream of the transcription start site. The core promoter region often contains a TATA box and an initiator element as well as the initiation site. The precise length of the core promoter region is not fixed but is usually well recognizable. Such a region is normally present, with some variation, in most promoters. The base sequences lying between the various well-characterized elements appear to be of lesser importance. The core promoter region is often referred to as a minimal promoter region because it is functional on its own to promote a basal level of transcription.

The presence of the core promoter region defines a sequence as being a promoter: if the region is absent, the promoter is non-functional. The core region acts to attract the general transcription machinery to the promoter for transcription initiation. However, the core promoter region is insufficient to provide full promoter activity. A series of regulatory sequences constitute the remainder of the promoter. The regulatory sequences determine expression level, the spatial and temporal pattern of expression and, for a subset of promoters, expression under inductive conditions (regulation by external factors such as light, temperature, chemicals and hormones). Regulatory sequences may be short regions of DNA sequence 6-100 base pairs that define the binding sites for trans-acting factors, such as transcription factors. Regulatory sequences may also be enhancers, longer regions of DNA sequence that can act from a distance from the core promoter region, sometimes over several kilobases from the core region. Regulatory sequence activity may be influenced by trans-acting factors including general transcription machinery, transcription factors and chromatin assembly factors.

Certain promoters are able to direct RNA synthesis at relatively similar levels across all tissues of a plant. These are called "constitutive promoters" or "tissue-independent" promoters. Constitutive promoters can be divided into strong, moderate, and weak categories according to their effectiveness to directing RNA synthesis. Since it is necessary in many cases to simultaneously express a chimeric gene (or genes) in different tissues of a plant to get the desired functions of the gene (or genes), constitutive promoters are especially useful in this regard. Though many constitutive promoters have been discovered from plants and plant viruses and characterized, there is still an ongoing interest in the isolation of more novel constitutive promoters, synthetic or natural, which are capable of controlling the expression of a chimeric gene (or genes) at different expression levels and the expression of multiple genes in the same transgenic plant for gene stacking.

Among the most commonly used promoters are the nopaline synthase (NOS) promoter (Ebert et al., Proc. Natl. Acad. Sci. USA 84:5745-5749 (1987)); the octapine synthase (OCS) promoter; caulimovirus promoters such as the cauliflower mosaic virus (CaMV) 19S promoter (Lawton et al., Plant Mol. Biol. 9:315-324 (1987)), the CaMV 35S promoter (Odell et al., Nature 313:810-812 (1985)), and the figwort mosaic virus 35S promoter (Sanger et al., Plant Mol. Biol. 14, 43343 (1990)); the light inducible promoter from the small subunit of rubisco (Pellegrineschi et al., Biochem. Soc. Trans. 23(2):247-250 (1995)); the Adh promoter (Walker et al., Proc. Natl. Acad. Sci. USA 84:6624-66280 (1987)); the sucrose synthase promoter (Yang et al., Proc. Natl. Acad. Sci. USA 87:414-44148 (1990)); the R gene complex promoter (Chandler et al., Plant Cell 1:1175-1183 (1989)); the chlorophyll a/b binding protein gene promoter; and the like.

SUMMARY

In view of these needs, it is an object of the present invention to provide a nucleic acid, preferably an isolated nucleic acid, capable of driving expression in a plant cell, wherein the nucleic acid sequence comprises a 5'-untranslated region, a first exon, a first intron, and a portion of a second exon of a gene represented by a sequence selected from the group consisting of SEQ ID NOs: 13-33. The invention further relates to the nucleic acid sequence which is selected from the group consisting of SEQ ID NOs: 1-3. In another aspect, the plant cell comprising the nucleic acid can be a monocot cell or a dicot cell. In yet another aspect, the plant cell comprising the nucleic acid can be a maize cell or a tobacco cell.

In another aspect, it is the object of the present invention to relate a method of expressing a heterologous gene comprising constructing an expression cassette comprising a promoter selected from the group comprising prZmHSP70 (SEQ ID NO: 1), prZmUbi158 (SEQ ID NO: 2), and prZmUbi361 (SEQ ID NO: 3), wherein the expression cassette is functional in a plant, plant cell, or plant tissue or portion thereof; and creating a plant, plant cell, or plant tissue or portion thereof comprising the expression cassette, wherein the heterologous gene is expressed. The invention further relates to expressing the heterologous gene in a plant, plant cell, or plant tissue or portion thereof wherein the plant, plant cell, or plant tissue or portion thereof is a monocot. The invention further relates to expressing the heterologous gene in a plant, plant cell, or plant tissue or portion thereof wherein the plant, plant cell, or plant tissue or portion thereof is maize. The invention further relates to expressing the heterologous gene in a plant, plant cell, or plant tissue or portion thereof wherein the plant, plant cell, or plant tissue or portion thereof is a dicot. The invention further relates to expressing the heterologous gene in a plant, plant cell, or plant tissue or portion thereof wherein the plant, plant cell, or plant tissue or portion thereof is tobacco or soybean.

In another aspect, the present invention also relates to a plant, plant cell, or plant tissue or portion thereof comprising an expression cassette comprising a promoter selected from the group comprising prZmHSP70 (SEQ ID NO: 1), prZmUbi158 (SEQ ID NO: 2), and prZmUbi361 (SEQ ID NO: 3). The invention further relates to the plant, plant cell, or plant tissue or portion thereof comprising the expression cassette, wherein the wherein the plant, plant cell, or plant tissue or portion thereof is a monocot. The invention further relates to the plant, plant cell, or plant tissue or portion thereof comprising the expression cassette, wherein the wherein the plant, plant cell, or plant tissue or portion thereof is maize. The invention further relates to the plant, plant cell, or plant tissue or portion thereof comprising the expression cassette, wherein the wherein the plant, plant cell, or plant tissue or portion thereof is a dicot. The invention further relates to the plant, plant cell, or plant tissue or portion thereof comprising the expression cassette, wherein the wherein the plant, plant cell, or plant tissue or portion thereof is tobacco or soybean.

In yet another aspect, the present invention also relates to an expression cassette comprising a promoter selected from the group comprising prZmHSP70 (SEQ ID NO: 1), prZmUbi158 (SEQ ID NO: 2), and prZmUbi361 (SEQ ID NO: 3).

In still yet another aspect, the present invention relates to a plant, plant cell, or plant tissue or portion thereof made by the method of expressing a heterologous gene comprising constructing an expression cassette comprising a promoter selected from the group comprising prZmHSP70 (SEQ ID NO: 1), prZmUbi158 (SEQ ID NO: 2), and prZmUbi361 (SEQ ID NO: 3), wherein the expression cassette is functional in a plant, plant cell, or plant tissue or portion thereof; and creating a plant, plant cell, or plant tissue or portion thereof comprising the expression cassette, wherein the heterologous gene is expressed. The invention further relates to expressing the heterologous gene in a plant, plant cell, or plant tissue or portion thereof wherein the plant, plant cell, or plant tissue or portion thereof is a monocot. The invention further relates to expressing the heterologous gene in a plant, plant cell, or plant tissue or portion thereof wherein the plant, plant cell, or plant tissue or portion thereof is maize. The invention further relates to expressing the heterologous gene in a plant, plant cell, or plant tissue or portion thereof wherein the plant, plant cell, or plant tissue or portion thereof is a dicot. The invention further relates to expressing the heterologous gene in a plant, plant cell, or plant tissue or portion thereof wherein the plant, plant cell, or plant tissue or portion thereof is selected from the group consisting of tobacco and soybean. In another aspect, the present invention also relates to progeny of the plant, plant cell, or plant tissue or portion thereof, comprising a promoter selected from the group comprising prZmHSP70 (SEQ ID NO: 1), prZmUbi158 (SEQ ID NO: 2), and prZmUbi361 (SEQ ID NO: 3). The present invention also relates to seed derived from the progeny of the plant, plant cell, or plant tissue or portion thereof. The present invention further relates to grain derived from seed derived from the progeny of the plant, plant cell, or plant tissue or portion thereof.

In yet another aspect, the present invention further relates to a nucleic acid sequence capable of driving expression in a plant cell, wherein the nucleic acid sequence comprises a nucleic acid sequence that is selected from the group consisting of (a) a nucleic acid sequence that is at least 80% identical to one of SEQ ID NOs: 1-3; (b) a nucleic acid sequence that is a functional fragment of one of SEQ ID NOs: 1-3; and (c) a nucleic acid sequence that hybridizes under stringent conditions to one of SEQ ID NOs: 1-3.

BRIEF DESCRIPTION OF THE SEQUENCES IN THE SEQUENCE LISTING

SEQ ID NO: 1 is the nucleotide sequence of prZmHSP70
SEQ ID NO: 2 is the nucleotide sequence of prZmUbi158
SEQ ID NO: 3 is the nucleotide sequence of prZmUbi361
SEQ ID NO: 4 is the nucleotide sequence of the ZmHSP70 binary construct 15907
SEQ ID NO: 5 is the nucleotide sequence of the ZmUbi158 binary construct 17239
SEQ ID NO: 6 is the nucleotide sequence of the ZmUbi361 binary construct 17282
SEQ ID NO: 7 is the nucleotide sequence of the TMV-omega translational enhancer sequence
SEQ ID NO: 8 is the nucleotide sequence of a maize-optimized Kozak sequence
SEQ ID NO: 9 is the nucleotide sequence of a maize-optimized Kozak sequence
SEQ ID NO: 10 is the nucleotide sequence of the ZmHSP70-GUS expression cassette
SEQ ID NO: 11 is the nucleotide sequence of the ZmUbi158-GUS expression cassette
SEQ ID NO: 12 is the nucleotide sequence of the ZmUbi361-GUS expression cassette
SEQ ID NO: 13 is the nucleotide sequence of the ZmUbi1 CTRL_U29159.1-3_AT probe
SEQ ID NO: 14 is the nucleotide sequence of the ZmHSP70 ZM052966_S_AT probe
SEQ ID NO: 15 is the nucleotide sequence of the ZmUbi158 CTRL_ZMU29158-3_AT probe
SEQ ID NO: 16 is the nucleotide sequence of the ZmUbi361 ZM066361_S_AT probe
SEQ ID NO: 17 is the nucleotide sequence of the cDNA GenBank accession number X73474
SEQ ID NO: 18 is the nucleotide sequence of the cDNA TIGR accession number TC279798
SEQ ID NO: 19 is the nucleotide sequence of the gDNA GenBank accession number AX099713
SEQ ID NO: 20 is the nucleotide sequence of the gDNA GenBank accession number CL315596.1
SEQ ID NO: 21 is the nucleotide sequence of the maize genome sequence contig MAGI__102343
SEQ ID NO: 22 is the nucleotide sequence of the native ZmHSP70 gene (AY222837)
SEQ ID NO: 23 is the nucleotide sequence of the cDNA GenBank accession number Q41751
SEQ ID NO: 24 is the nucleotide sequence of the gDNA GenBank accession number AC196154
SEQ ID NO: 25 is the nucleotide sequence of the gDNA GenBank accession number 594466
SEQ ID NO: 26 is the nucleotide sequence of the maize genome sequence contig MAGI__6372
SEQ ID NO: 27 is the nucleotide sequence of the native ZmUbi158 gene
SEQ ID NO: 28 is the nucleotide sequence of the consensus cDNA TIGR accession number TC369342-cDNA
SEQ ID NO: 29 is the nucleotide sequence of the gDNA GenBank accession number AC196194
SEQ ID NO: 30 is the nucleotide sequence of the gDNA GenBank accession number U29162.1

SEQ ID NO: 31 is the nucleotide sequence of the maize genome sequence contig MAGI_11628

SEQ ID NO: 32 is the nucleotide sequence of the maize genome sequence contig MAGI_56231

SEQ ID NO: 33 is the nucleotide sequence of the native ZmUbi361 gene

SEQ ID NO: 34 is the nucleotide sequence of the ZmHSP70 assembly construct 15902

SEQ ID NO: 35 is the nucleotide sequence of the ZmUbi158 assembly construct 17222

SEQ ID NO: 36 is the nucleotide sequence of the ZmUbi361 assembly construct 17267

SEQ ID NO: 37 is the nucleotide sequence of pCR2.1

SEQ ID NO: 38 is the nucleotide sequence of pNOV6901

SEQ ID NO: 39 is the nucleotide sequence of the 1104 bp of 5'-non-transcribed sequence of ZmHSP70

SEQ ID NO: 40 is the nucleotide sequence of the 304 bp 5'-untranslated leader sequence of ZmHSP70

SEQ ID NO: 41 is the nucleotide sequence of the 1602 bp ZmHSP70 intron

SEQ ID NO: 42 is the nucleotide sequence of a 459 bp 3'-untranslated sequence of ZmHSP70

SEQ ID NO: 43 is the nucleotide sequence of a 535 bp of 3'-non-transcribed ZmHSP70 sequence SEQ ID NO: 44 is the nucleotide sequence of the terminator derived from ZmHSP70

SEQ ID NO: 45 is the nucleotide sequence of the 1506 bp of 5'-non-transcribed sequence of ZmUbi158

SEQ ID NO: 46 is the nucleotide sequence of the 163 bp 5'-untranslated leader sequence of ZmUbi158

SEQ ID NO: 47 is the nucleotide sequence of the tobacco etch virus omega translational enhancer SEQ ID NO: 48 is the nucleotide sequence of the 2386 bp ZmUbi158 first intron SEQ ID NO: 49 is the nucleotide sequence of a 341 bp 3'-untranslated sequence of ZmUbi158

SEQ ID NO: 50 is the nucleotide sequence of a 660 bp of 3'-non-transcribed ZmUbi158 sequence SEQ ID NO: 51 is the nucleotide sequence of the 1501 bp of 5'-non-transcribed sequence of ZmUbi361

SEQ ID NO: 52 is the nucleotide sequence of a 260 bp 5'-untranslated leader sequence of ZmUbi361

SEQ ID NO: 53 is the nucleotide sequence of the 1329 bp ZmUbi361 intron

SEQ ID NO: 54 is the nucleotide sequence of the terminator derived from ZmUbi361

SEQ ID NO: 55 is the nucleotide sequence of the terminator derived from ZmUbi158

SEQ ID NO: 56 is the nucleotide sequence of the 65 bp 3'-untranslated sequence of ZmUbi361

SEQ ID NO: 57 is the nucleotide sequence of the 936 bp of 3'-non-transcribed ZmUbi361 sequence SEQ ID NO: 58 is the nucleotide sequence of pCR4-TOPO SEQ ID NO: 59 is the nucleotide sequence of vector 17680

SEQ ID NO: 60 is the nucleotide sequence of vector 18271

SEQ ID NO: 61 is the nucleotide sequence of vector 18272

DEFINITIONS

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

The term "abiotic stress" refers to nonliving environmental factors such as frost, drought, excessive heat, high winds, etc., that can have harmful effects on plants.

The term "nucleic acid" refers to a polynucleotide of high molecular weight which can be single-stranded or double-stranded, composed of monomers (nucleotides) containing a sugar, phosphate and a base which is either a purine or pyrimidine. A "nucleic acid fragment" is a fraction of a given nucleic acid molecule. In higher plants, deoxyribonucleic acid (DNA) is the genetic material while ribonucleic acid (RNA) is involved in the transfer of information contained within DNA into proteins. A "genome" is the entire body of genetic material contained in each cell of an organism. The term "nucleotide sequence" refers to a polymer of DNA or RNA which can be single- or double-stranded, optionally containing synthetic, non-natural or altered nucleotide bases capable of incorporation into DNA or RNA polymers. Unless otherwise indicated, a particular nucleic acid sequence of this invention also implicitly encompasses conservatively modified variants thereof (e.g. degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer, et al., Nucleic Acid Res. 19:5081 (1991); Ohtsuka, et al., J. Biol. Chem. 260:2605-2608 (1985); and Rossolini, et al., Mol. Cell. Probes 8:91-98 (1994)). The term nucleic acid is used interchangeably with gene, cDNA, and mRNA encoded by a gene.

"Operably-linked" refers to the association of nucleic acid sequences on a single nucleic acid fragment so that the function of one is affected by the other. For example, a promoter is operably-linked with a coding sequence or functional RNA when it is capable of affecting the expression of that coding sequence or functional RNA (i.e., that the coding sequence or functional RNA is under the transcriptional control of the promoter). Coding sequences in sense or antisense orientation can be operably-linked to regulatory sequences.

"Promoter" refers to a nucleotide sequence, which controls the expression of a coding sequence by providing the recognition for RNA polymerase and other factors required for proper transcription. "Promoter regulatory sequences" can comprise proximal and more distal upstream elements and/or downstream elements. Promoter regulatory sequences influence the transcription, RNA processing or stability, or translation of the associated coding sequence. Promoter regulatory sequences include enhancers, untranslated leader sequences, introns, exons, and polyadenylation signal sequences. They include natural and synthetic sequences as well as sequences that can be a combination of synthetic and natural sequences. An "enhancer" is a nucleotide sequence that can stimulate promoter activity and can be an innate element of the promoter or a heterologous element inserted to enhance the level or tissue specificity of a promoter. The coding sequence can be present on either strand of a double-stranded DNA molecule, and is capable of functioning even when placed either upstream or downstream from the promoter. The meaning of the term "promoter" includes "promoter regulatory sequences."

"Primary transformant" and "T0 generation" refer to transgenic plants that are of the same genetic generation as the tissue that was initially transformed (i.e., not having gone through meiosis and fertilization since transformation). "Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

"Gene" refers to a nucleic acid fragment that expresses mRNA, functional RNA, or specific protein, including regulatory sequences. The term "Native gene" refers to a gene as found in nature. The term "chimeric gene" refers to any gene that contains 1) DNA sequences, including regulatory and coding sequences, that are not found together in nature, or 2) sequences encoding parts of proteins not naturally adjoined, or 3) parts of promoters that are not naturally adjoined. Accordingly, a chimeric gene may comprise regulatory sequences and coding sequences that are derived from different sources, or comprise regulatory sequences and coding sequences derived from the same source, but arranged in a manner different from that found in nature. A "transgene" refers to a gene that has been introduced into the genome by transformation and is stably maintained. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but one that is introduced into the organism by gene transfer.

"Expression cassette" as used herein means a DNA sequence capable of directing expression of a particular nucleotide sequence in an appropriate host cell, comprising a promoter operably linked to the nucleotide sequence of interest which is operably linked to termination signals. It also typically comprises sequences required for proper translation of the nucleotide sequence. The coding region usually codes for a protein of interest but may also code for a functional RNA of interest, for example antisense RNA or a nontranslated RNA, in the sense or antisense direction. The expression cassette comprising the nucleotide sequence of interest may be chimeric, meaning that at least one of its components is heterologous with respect to at least one of its other components.

"Intron" refers to an intervening section of DNA which occurs almost exclusively within a eukaryotic gene, but which is not translated to amino acid sequences in the gene product. The introns are removed from the pre-mature mRNA through a process called splicing, which leaves the exons untouched, to form an mRNA. For purposes of the present invention, the definition of the term "intron" includes modifications to the nucleotide sequence of an intron derived from a target gene.

"Exon" refers to a section of DNA which carries the coding sequence for a protein or part of it. Exons are separated by intervening, non-coding sequences (introns). For purposes of the present invention, the definition of the term "exon" includes modifications to the nucleotide sequence of an exon derived from a target gene.

Expression or overexpression of a gene involves transcription of the gene and translation of the mRNA into a precursor or mature protein. "Antisense inhibition" refers to the production of antisense RNA transcripts capable of suppressing the expression of the target protein. "Overexpression" refers to the production of a gene product in transgenic organisms that exceeds levels of production in normal or non-transformed organisms. "Co-suppression" refers to the production of sense RNA transcripts capable of suppressing the expression or transcript accumulation of identical or substantially similar foreign or endogenous genes. The mechanism of co-suppression may be at the DNA level (such as DNA methylation), at the transcriptional level, or at post-transcriptional level.

The term "constitutive promoter" refers to a promoter active in all or most tissues of a plant at all or most developing stages. As with other promoters classified as constitutive, some variation in absolute levels of expression can exist among different tissues or stages.

The term "constitutive promoter" or "tissue-independent" are used interchangeably herewithin.

An "isolated nucleic acid fragment" refers to a polymer of ribonucleotides (RNA) or deoxyribonucleotides (DNA) that is single- or double-stranded, optionally containing synthetic, non-natural or altered nucleotide bases. An isolated nucleic acid fragment in the form of DNA may be comprised of one or more segments of cDNA, genomic DNA or synthetic DNA.

The terms "polynucleotide", "polynucleotide sequence", "nucleic acid sequence", and "nucleic acid fragment"/"isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

A "heterologous nucleic acid fragment" refers to a sequence that is not naturally occurring with the plant promoter sequence of the invention. While this nucleotide sequence is heterologous to the promoter sequence, it may be homologous, or native, or heterologous, or foreign, to the plant host. However, it is recognized that the instant promoters may be used with their native coding sequences to increase or decrease expression resulting in a change in phenotype in the transformed seed.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in co-suppression or antisense by linking a nucleic acid fragment or subfragment thereof, whether or not it encodes an active enzyme, in the appropriate orientation relative to a plant promoter sequence.

The terms "substantially similar" and "corresponding substantially" as used herein refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

The "3'non-coding sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., Plant Cell 1:671-680 (1989).

"Transformation" refers to the transfer of a nucleic acid fragment into the genome of a host organism, resulting in genetically stable inheritance. Host organisms containing the transformed nucleic acid fragments are referred to as "transgenic" organisms.

"Transient expression" refers to the temporary expression of often reporter genes such as β-glucuronidase (GUS), fluorescent protein genes GFP, ZS-YELLOW1 N1, AM-CYAN1, DS-RED in selected certain cell types of the host organism in which the transgenic gene is introduced temporally by a transformation method.

Standard recombinant DNA and molecular cloning techniques used herein are well known in the art and are described more fully in Sambrook, J. et al., In Molecular Cloning: A Laboratory Manual; $2^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In Current Protocols in Molecular Biology; John Wiley and Sons: New York, 1990 (hereinafter "Ausubel et al., 1990").

"PCR" or "Polymerase Chain Reaction" is a technique for the synthesis of large quantities of specific DNA segments, consisting of a series of repetitive cycles (Perkin Elmer Cetus Instruments, Norwalk, Conn.). Typically, the double stranded DNA is heat denatured, the two primers complementary to the 3' boundaries of the target segment are annealed at low temperature and then extended at an intermediate temperature. One set of these three consecutive steps comprises a cycle.

As used herein, the phrase "stringent hybridization conditions" refers to conditions under which a polynucleotide hybridizes to its target subsequence, typically in a complex mixture of nucleic acids, but to essentially no other sequences. Stringent conditions are sequence-dependent and can be different under different circumstances. Longer sequences typically hybridize specifically at higher temperatures. An extensive guide to the hybridization of nucleic acids is found in Tijssen, 1993. Generally, stringent conditions are selected to be about 5-10° C. lower than the thermal melting point (Tm) for the specific sequence at a defined ionic strength and pH. The Tm is the temperature (under defined ionic strength, pH, and nucleic acid concentration) at which 50% of the probes complementary to the target hybridize to the target sequence at equilibrium (as the target sequences are present in excess, at Tm, 50% of the probes are occupied at equilibrium). Exemplary stringent hybridization is performed at a temperature of 65° C., preferably 60° C. and most preferably 55° C. in double strength (2x) citrate buffered saline (SSC) containing 0.1% SDS followed by rinsing of the support at the same temperature but with a buffer having a reduced SSC concentration. Such reduced concentration buffers are typically one tenth strength SSC (0.1xSSC) containing 0.1% SDS, preferably 0.2xSSC containing 0.1% SSC and most preferably half strength SSC (0.5xSSC) containing 0.1% SDS.

DETAILED DESCRIPTION

The promoter nucleotide sequences and methods disclosed herein are useful in regulating expression of any heterologous nucleic acid sequences in a host plant in order to alter the phenotype of a plant.

Various changes in phenotype are of interest including, but not limited to, modifying the fatty acid composition in a plant, altering the amino acid composition of a plant, altering a plant's pathogen defense system, altering plant response to the environment, and the like. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

Genes of interest are reflective of the commercial markets and interests of those involved in the development of the crop. Crops and markets of interest change, and as developing nations open up world markets, new crops and technologies will emerge also. In addition, as our understanding of agronomic characteristics and traits such as yield and heterosis increase, the choice of genes for transformation will change accordingly. Categories of transgenes, also known as heterologous genes, for example, include, but are not limited to, genes encoding important agronomic traits, insect resistance, disease resistance, herbicide resistance, sterility, grain or seed characteristics, and commercial products. Genes of interest include, generally, those involved in oil, starch, carbohydrate, or nutrient metabolism as well as those affecting seed size, plant development, plant growth regulation, and yield improvement. Plant development and growth regulation also refer to the development and growth regulation of various parts of a plant, such as the flower, seed, root, leaf, and shoot.

Other commercially desirable traits are genes and proteins conferring cold, heat, salt, and drought resistance.

Disease and/or insect resistance genes may encode resistance to pests that have great yield drag such as for example, anthracnose, soybean mosaic virus, soybean cyst nematode, root-knot nematode, brown leaf spot, Downy mildew, purple seed stain, seed decay, and seedling diseases commonly caused by the fungi *Pythium* sp., *Phytophthora* sp., *Rhizoctonia* sp., *Diaporthe* sp. Bacterial blight caused by the bacterium *Pseudomonas syringae* pv. Glycinea. Genes conferring insect resistance include, for example, *Bacillus thuringiensis* toxic protein genes (U.S. Pat. Nos. 5,366,892; 5,747,450; 5,737,514; 5,723,756; 5,593,881; and Geiser et al (1986) Gene 48:109); lectins (Van Damme et al. (1994) Plant Mol. Biol. 24:825); and the like.

Herbicide resistance traits may include genes coding for resistance to herbicides that act to inhibit the action of acetolactate synthase (ALS), in particular the sulfonylurea-type herbicides (e.g., the acetolactate synthase ALS gene containing mutations leading to such resistance, in particular the S4 and/or HRA mutations). The ALS-gene mutants encode resistance to the herbicide chlorosulfuron. Glyphosate acetyl transferase (GAT) is an N-acetyltransferase from *Bacillus licheniformis* that was optimized by gene shuffling for acetylation of the broad spectrum herbicide, glyphosate, forming the basis of a novel mechanism of glyphosate tolerance in transgenic plants (Castle et al. (2004) Science 304, 1151-1154). Other herbicide resistance traits would be obvious to use to one skilled in the art.

The promoter sequences, preferably isolated promoter sequences, of the present invention can be modified to provide a range of constitutive expression levels of the heterologous nucleotide sequence. Thus, less than the entire promoter regions may be utilized and the ability to drive expression of the coding sequence retained. However, it is recognized that expression levels of the mRNA may be decreased with deletions of portions of the promoter sequences. In some cases, reduced expression may be desirable. Modification of the promoter sequences may change the tissue-independent, constitutive nature of expression. Therefore, fragments of SEQ ID NOs: 1-3 which are 80%, 81%, 82%, 83%, 84%, 85%, 86%, 87%, 88%, 89%, 90%, 91%, 92%, 93%, 94%, 95%, 96%, 97%, 98%, or 99% identical to SEQ ID NOs: 1-3 may still function as exemplified by this description.

In order to identify maize candidate genes and their regulatory sequences appropriate for expression cassette development, maize expression profiling data from a developmental expression profiling series were analyzed for probes that demonstrated the highest average signal across all samples. The average signal was calculated for each probe then each probe was ranked based on average signal. The CTRL_U29159.1-3_AT probe (SEQ ID NO: 13) representing ZmUbi1, a well-characterized constitutive expression cassette, ranks $7^{th}$ in this analysis. This analysis was the basis for selecting 3 additional promoter candidates for constitutive expression cassette construction: ZmHSP70, ranked $2^{nd}$ (SEQ ID NO: 23), ZmUbi158, ranked $3^{rd}$ (SEQ ID NO: 30), and ZmUbi361, ranked $10^{th}$ (SEQ ID NO: 38). The data in Table 1 (Top10 Constitutive) summarizes the results.

TABLE 1

Relative Signal Strength of Expression in Tissues

| | Probe Set | | | | |
| --- | --- | --- | --- | --- | --- |
| Source Tissue | ZMGLYR_AT | ZM052966_S_AT (ZmHSP70) | CTRL_ZMU29158-3_AT (ZmUbi158) | ZM053951_S_AT | ZM061586_S_AT |
| root seminal and radical | 10907.15 | 9217.56 | 9572.11 | 10412.69 | 10060.77 |
| adult roots | 10903.13 | 10001.66 | 9965.31 | 8997.16 | 10155.24 |
| roots Nodal | 11760.50 | 9542.12 | 10056.97 | 10329.44 | 9358.79 |
| juvinile leaf | 9518.35 | 7137.70 | 6566.96 | 8350.58 | 9641.96 |
| Senescence Leaf | 10018.55 | 7497.50 | 7710.78 | 5641.76 | 6446.74 |
| Pith V8 | 9326.25 | 8031.77 | 9436.65 | 9599.32 | 8547.60 |
| Pith V16 | 14594.27 | 13693.39 | 12272.07 | 11219.01 | 7632.49 |
| Developing ear 3 cm | 8177.18 | 9015.15 | 7803.35 | 8266.07 | 7067.92 |
| Developing ear 7 cm | 607.48 | 76.06 | 484.12 | 1281.35 | 73.59 |
| whole kernel 6 day | 11679.11 | 9566.74 | 8771.16 | 9721.33 | 7104.92 |
| whole kernel 14 day | 13389.77 | 8975.52 | 9415.35 | 9525.77 | 9661.14 |
| embryo 21 DAP | 10643.19 | 8800.73 | 8430.46 | 9243.28 | 8011.14 |
| embryo 38 DAP | 12015.99 | 12339.52 | 11046.12 | 9159.61 | 9159.66 |
| germ seed day 4 root | 10066.62 | 8472.70 | 7819.38 | 8064.94 | 9221.40 |
| germ seed day 4 leaf | 9941.40 | 8751.84 | 8256.62 | 7591.37 | 9020.52 |
| tassel V9 | 8259.98 | 8274.28 | 7500.03 | 7842.82 | 7005.32 |
| tassel V12 | 10924.53 | 10288.79 | 9028.84 | 10011.80 | 9066.98 |
| tassel V15 | 9274.22 | 6979.61 | 7846.33 | 9202.04 | 9211.33 |
| pollen | 9126.88 | 286.29 | 7254.20 | 16575.82 | 19141.66 |
| stem V8 | 10058.22 | 8371.50 | 9367.13 | 9473.01 | 9188.67 |
| silk at pollen shed | 10802.07 | 10034.99 | 9891.29 | 9913.21 | 9687.58 |
| silk 6 hr post pollen | 9792.35 | 8673.96 | 8430.56 | 8422.46 | 7907.84 |
| endosperm 18 DAP | 13397.68 | 13009.87 | 11099.11 | 9561.22 | 9093.59 |
| endosperm 34 DAP | 9289.95 | 6636.56 | 6922.05 | 6703.88 | 5729.43 |
| ovule total RNA | 10111.60 | 10188.94 | 10644.03 | 6577.37 | 10832.81 |
| Glume Total RNA | 14327.61 | 12774.00 | 12605.20 | 7790.93 | 13960.66 |
| cob-pith | 6503.41 | 6185.30 | 5753.57 | 5856.25 | 4865.52 |
| ovules | 12820.39 | 13769.27 | 12621.25 | 10368.72 | 12429.59 |
| 1 DAP pistils | 12267.82 | 13199.19 | 11425.03 | 11407.76 | 6356.14 |
| 3 DAP pisitls | 12158.15 | 11033.95 | 12346.68 | 11409.95 | 9136.00 |
| 7 DAP pisitls | 13391.55 | 13597.54 | 12418.38 | 12070.45 | 8879.08 |
| Mean Signal Strength | 10517.91 | 9174.97 | 9121.33 | 9051.33 | 8827.62 |
| Standard Deviation | 2624.81 | 3241.63 | 2488.37 | 2525.97 | 3067.59 |

| | Probe Set | | | | |
| --- | --- | --- | --- | --- | --- |
| Source Tissue | ZM052966_X_AT | CTRL_U29159.1-3_AT (ZmUbi1) | ZM066306_S_AT | ZM005767_S_AT | ZM066361_S_AT (ZmUbi361) |
| root seminal and radical | 9315.47 | 8555.27 | 7750.42 | 7708.88 | 10177.94 |
| adult roots | 10120.03 | 10505.06 | 7667.23 | 7603.02 | 9921.92 |
| roots Nodal | 9811.43 | 9492.46 | 8537.38 | 8394.66 | 9218.59 |
| juvinile leaf | 7553.12 | 5037.83 | 6077.48 | 5717.33 | 7487.63 |
| Senescence Leaf | 7476.21 | 7450.23 | 2994.93 | 3008.72 | 7478.51 |
| Pith V8 | 8188.00 | 7363.40 | 8248.54 | 7856.22 | 6788.14 |
| Pith V16 | 13763.43 | 10582.39 | 9896.16 | 9923.44 | 10345.79 |
| Developing ear 3 cm | 8648.09 | 6579.52 | 7773.56 | 7491.95 | 5926.66 |
| Developing ear 7 cm | 139.70 | 499.13 | 266.03 | 284.39 | 274.11 |
| whole kernel 6 day | 9557.31 | 7663.38 | 7717.82 | 7817.33 | 6916.97 |
| whole kernel 14 day | 10472.04 | 7713.56 | 6221.95 | 6521.93 | 6013.73 |
| embryo 21 DAP | 8504.44 | 6908.90 | 7796.26 | 7716.60 | 5819.63 |
| embryo 38 DAP | 11808.95 | 11447.82 | 10177.94 | 10256.65 | 7254.75 |
| germ seed day 4 root | 8764.92 | 8639.81 | 7071.09 | 6630.08 | 8194.64 |
| germ seed day 4 leaf | 8605.23 | 8672.62 | 7518.66 | 7417.38 | 7752.10 |

TABLE 1-continued

Relative Signal Strength of Expression in Tissues

| tassel V9 | 8075.52 | 6121.51 | 7230.14 | 6797.39 | 5537.46 |
|---|---|---|---|---|---|
| tassel V12 | 10310.96 | 8362.43 | 8872.89 | 8897.63 | 6978.87 |
| tassel V15 | 7668.53 | 8887.16 | 6383.93 | 6229.51 | 5742.48 |
| pollen | 363.79 | 16480.52 | 14143.54 | 14079.72 | 2659.64 |
| stem V8 | 8453.50 | 7235.99 | 7894.02 | 7741.64 | 7045.43 |
| silk at pollen shed | 10364.53 | 6942.36 | 9752.02 | 9148.55 | 5780.80 |
| silk 6 hr post pollen | 8835.64 | 6528.25 | 7701.26 | 7650.39 | 5166.31 |
| endosperm 18 DAP | 12071.60 | 10813.15 | 6930.90 | 7304.75 | 6665.10 |
| endosperm 34 DAP | 6919.00 | 6949.99 | 5635.90 | 5413.97 | 5380.62 |
| ovule total RNA | 10261.25 | 10209.65 | 8538.09 | 8176.83 | 8143.43 |
| Glume Total RNA | 12928.76 | 12904.97 | 12578.31 | 11797.52 | 9104.01 |
| cob-pith | 6079.49 | 4732.42 | 5511.93 | 5428.60 | 4140.28 |
| ovules | 9307.86 | 12515.98 | 13615.20 | 13090.07 | 10874.61 |
| 1 DAP pistils | 9085.17 | 10524.48 | 11647.45 | 11314.44 | 8973.97 |
| 3 DAP pisitls | 6732.52 | 10897.63 | 11477.10 | 11233.68 | 9293.46 |
| 7 DAP pisitls | 9649.21 | 11810.20 | 13129.90 | 12775.99 | 9691.12 |
| Mean Signal Strength | 8704.38 | 8678.32 | 8282.52 | 8110.62 | 7120.93 |
| Standard Deviation | 2843.85 | 2953.33 | 2953.36 | 2860.73 | 2317.33 |

Plasmid vectors comprising the recombinant expression cassettes of the present invention can be constructed. The choice of plasmid vector is dependent upon the method that will be used to transform host cells. The skilled artisan is well aware of the genetic elements that must be present on the plasmid vector in order to successfully transform, select and propagate host cells containing the chimeric gene.

Methods for transforming monocots, primarily by use of *Agrobacterium tumefaciens*, and obtaining transgenic plants have been published for monocots (U.S. Pat. No. 6,037,522), wheat (Cheng et al., Plant Cell Rep. 15:971-980 (1997), and in particular maize (U.S. Pat. No. 6,051,409). Methods for transforming dicots, primarily by use of *Agrobacterium tumefaciens*, and obtaining transgenic plants have been published, among others, for cotton (U.S. Pat. No. 5,004,863, U.S. Pat. No. 5,159,135); soybean (U.S. Pat. No. 5,569,834, U.S. Pat. No. 5,416,011); Brassica (U.S. Pat. No. 5,463,174); and peanut (Cheng et al., Plant Cell Rep. 15:653-657 (1996), McKently et al., Plant Cell Rep. 14:699-703 (1995)). For a review of other commonly used methods of plant transformation see Newell, C. A., Mol. Biotechnol. 16:53-65 (2000).

There are a variety of methods for the regeneration of plants from plant tissues. The particular method of regeneration will depend on the starting plant tissue and the particular plant species to be regenerated. The regeneration, development and cultivation of plants from single plant protoplast transformants or from various transformed explants is well known in the art (Weissbach and Weissbach, Eds.; In Methods for Plant Molecular Biology; Academic Press, Inc.: San Diego, Calif., 1988). This regeneration and growth process typically includes the steps of selection of transformed cells, culturing those individualized cells through the usual stages of embryonic development or through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant DNA fragments and recombinant expression constructs and the screening and isolating of clones, (see for example, Sambrook, J. et al., In Molecular Cloning: A Laboratory Manual; $2^{nd}$ ed.; Cold Spring Harbor Laboratory Press: Cold Spring Harbor, N.Y., 1989; Maliga et al., In Methods in Plant Molecular Biology; Cold Spring Harbor Press, 1995; Birren et al., In Genome Analysis: Detecting Genes, 1; Cold Spring Harbor: New York, 1998; Birren et al., In Genome Analysis: Analyzing DNA, 2; Cold Spring Harbor: New York, 1998; Clark, Ed., In Plant Molecular Biology: A Laboratory Manual; Springer: New York, 1997).

The skilled artisan will also recognize that different independent transformation events will result in different levels and patterns of expression of the chimeric genes (Jones et al., EMBO J. 4:2411-2418 (1985); De Almeida et al., Mol. Gen. Genetics 218:78-86 (1989)). Thus, multiple events must be screened in order to obtain lines displaying the desired expression level and pattern. Such screening may be accomplished by Northern analysis of mRNA expression, Western analysis of protein expression, or phenotypic analysis. Also of interest are seeds obtained from transformed plants displaying the desired gene expression profile.

Transformation and selection can be accomplished using methods well-known to those skilled in the art including, but not limited to, the methods described herein.

EXAMPLES

Example 1

ZmHSP70

The ZmHSP70 GeneChip probe, ZM052966_S_AT (SEQ ID NO: 14), was used to identify corresponding cDNAs and gDNAs in genomic databases. The cDNAs identified include GenBank accession X73474 (SEQ ID NO: 17) and TIGR accession TC279798 (SEQ ID NO: 18). The gDNAs include GenBank accessions AX099713 (SEQ ID NO: 19) and CL315596.1 (SEQ ID NO: 20), and maize genome sequence contig MAGI__102343 (SEQ ID NO: 21). These sequences were used to develop a base-level annotation of the ZmHSP70 gene (SEQ ID NO: 22). The ZmHSP70 gene comprises two exons separated by one intron. The sequence data were used to design an expression cassette following the method used to make the OsMADS expression cassettes as disclosed in US Patent Application Publication No. US 2007/0006344, herein incorporated by reference in its entirety. Upstream of the gene of interest (GOI) the finished expression cassette comprises the ZmHSP70 promoter containing 1104 bp of 5'-non-transcribed sequence (SEQ ID NO: 39), a 304 bp 5'-untranslated leader sequence (SEQ ID NO: 40) that terminates in a maize-optimized Kozak sequence (gtaaaccatgg, SEQ ID NO: 9), and the 1602 bp ZmHSP70 intron (SEQ ID NO: 51). The ZmHSP70 protein coding sequence was silenced by mutating translation start codons and altering other codons to insert translation stops upstream of the engineered translation start codon (at the NcoI) site. Downstream of the GOI, the expression cassette comprises a terminator sequence (SEQ ID NO: 44) derived from the ZmHSP70 gene. It comprises a 459 bp 3'-untranslated sequence (SEQ ID NO: 42) that starts just past the translation stop codon plus 535 bp of 3'-non-transcribed ZmHSP70 sequence (SEQ ID NO: 43). SEQ ID NOs: 34 and 4 define the ZmHSP70 assembly and binary vectors, respectively. In both cases the ZmHSP70 expression cassette (SEQ ID NO: 10) comprises the β-glucuronidase (GUS) reporter gene.

The ZmHSP70 assembly vector (SEQ ID NO: 34) was created by the following method: The HSP70 terminus (SEQ ID NO: 44) was PCR amplified from maize genomic DNA and cloned into pNOV6901 as a SacI/XmaI fragment. The QUIKCHANGE® method (Stratagene) was used to correct one base disparity. The HSP70 promoter (prZmHSP70) was PCR amplified from maize genomic DNA, which was subsequently TOPO® (Invitrogen) cloned into pCR2.1 (SEQ ID NO: 37). Further QUICKCHANGE®-mediated site-directed mutagenesis deleted start codon (ATG) sites in 5'-UTR region, inactivated two SacI sites, and corrected one base discrepancy in the intron. The modified prZmHSP70 was cloned into recombinant GUS:tZmHSP70 (pNOV6901, SEQ ID NO: 38) as an XhoI/NcoI fragment.

The ZmHSP70 binary vector (SEQ ID NO: 4) was created by the following method: The recipient vector was linearized with the restriction enzyme RsrII. The ZmHSP70 assembly vector was digested with restriction enzymes RsrII and SanDI, excising the expression cassette as defined by SEQ ID NO: 10. The expression cassette was then cloned into the recipient vector at the RsrII site.

The ZmHSP70 binary vector (SEQ ID NO: 4) was transformed into maize by *Agrobacterium* transformation, a technique well known to those skilled in the art. Of the 46 events that were produced, 17 set seed. The GUS enzyme in fully expanded leaves was assayed by histochemical localization (all events) and enzyme activity (select events).

Leaf punches from seventeen T0 maize plants were sampled for histochemical analysis of GUS activity driven by ZmHSP70 expression cassette, fifteen plants showed positive GUS expression, and all positive expression showed light staining intensity. To confirm the prZmHSP70-driven GUS expression, we conducted GUS activity analysis by 4-methylumbelliferone β-D-galactopyranoside (MUG) assay method (Armenta, et al.) from several plant samples. Histochemical analysis is a purely qualitative measure in this instance. The GUS enzyme activity assay provides quantitative information through extraction and analysis of the protein produced by the transgene. The prZmHSP70-driven GUS expresses strongly in a leaf surface structure like "papillae" or "glandular hairs" or "trichomes" (protrusions of the epidermal surface).

Events MZAS2007020377A005A and MZAS2007020377A010A are single-copy, GUS positive and produced ample seed. They were selected for T1 analysis. Segregation was consistent with the T0 data. Table 2 summarizes analysis of F1 seedlings. Three assays were performed to examine GUS reporter gene activity in young leaf tissue from each plant: histochemical localization, ELISA, and enzyme activity. Based on these results, plants were selected for developmental assessment of GUS expression.

TABLE 2 prZmHSP70 Plant Characterization Summary

| Plant ID | GUS ELISA[1] | Mug Activity[2] |
|---|---|---|
| {AX5707/MZAS2007020377A005A}2 | 124 | 548 |
| {AX5707/MZAS2007020377A005A}3 | 129 | 752 |
| {AX5707/MZAS2007020377A005A}8 | 132 | 552 |
| {AX5707/MZAS2007020377A005A}10 | 128 | 675 |
| {AX5707/MZAS2007020377A005A}12 | 116 | 730 |
| {AX5707/MZAS2007020377A005A}16 | 180 | 1010 |
| {AX5707/MZAS2007020377A005A}18 | 207 | 1167 |
| {AX5707/MZAS2007020377A005A}19 | 114 | 644 |
| {AX5707/MZAS2007020377A005A}24 | 206 | 1325 |
| {AX5707/MZAS2007020377A010A}1 | 550 | 4800 |
| {AX5707/MZAS2007020377A010A}5 | 608 | 4892 |
| {AX5707/MZAS2007020377A010A}6 | 739 | 7713 |
| {AX5707/MZAS2007020377A010A}13 | 609 | 4947 |
| {AX5707/MZAS2007020377A010A}16 | 529 | 5515 |
| {AX5707/MZAS2007020377A010A}17 | 532 | 4922 |
| {AX5707/MZAS2007020377A010A}20 | 723 | 6124 |
| {AX5707/MZAS2007020377A010A}21 | 531 | 5313 |

[1]ng/mg soluble protein
[2]pmol/min/mg protein

A further experiment with MZAS2007020377A005A seedlings examined GUS activity in response to heat shock. Two week old plants were subject to heat shock at 42° C. for 2 hours, then GUS activity was assayed by ELISA and enzyme assay. The results are in Table 3. There was no discernable difference in GUS activity between the control plants and those subjected to heat shock.

TABLE 3

GUS Activity in Response to Heat Shock.

| | Plant ID | Event Info | GUS ELISA | Mug Activity |
|---|---|---|---|---|
| Control | 15907-1 | 005A | 804 | 9826 |
| | 15907-6 | 005A | 733 | 8892 |
| | 15907-8 | 005A | 717 | 9821 |
| | 15907-12 | 005A | 759 | 9897 |
| | 15907-14 | 005A | 761 | 10593 |
| | 15907-16 | 005A | 693 | 7502 |
| | 15907-17 | 005A | 664 | 9688 |
| | 15907-19 | 005A | 592 | 8318 |
| | 15907-20 | 005A | 668 | 7983 |
| | 15907-22 | 005A | 652 | 7822 |
| | 15907-24 | 005A | 759 | 10502 |
| | 15907-45 | 010A | 585 | 8380 |
| | 15907-46 | 010A | 790 | 8560 |
| | Average | | 706 | 9060 |
| Heat Shock | 15907-27 | 005A | 680 | 8821 |
| | 15907-28 | 005A | 573 | 7936 |
| | 15907-29 | 005A | 625 | 9290 |
| | 15907-30 | 005A | 745 | 9307 |
| | 15907-32 | 005A | 455 | 8152 |
| | 15907-34 | 005A | 574 | 8485 |
| | 15907-35 | 005A | 597 | 7668 |
| | 15907-36 | 005A | 676 | 7645 |
| | 15907-38 | 005A | 601 | 11052 |
| | 15907-40 | 005A | 538 | 9217 |

TABLE 3-continued

GUS Activity in Response to Heat Shock.

| Plant ID | Event Info | GUS ELISA | Mug Activity |
|---|---|---|---|
| 15907-42 | 005A | 464 | 9776 |
| 15907-47 | 010A | 648 | 9960 |
| 15907-48 | 010A | 774 | 11836 |
| | Average | 612 | 9165 |

[1]ng/mg total protein
[2]pmol/min/mg protein

Table 4 provides data summarizes histochemical localization data in ZmHSP70 T1/B1 plant reproductive tissue.

TABLE 4

T1/B1 histochemical localization results for 15907 events.

| Plant ID | Sample Time | Silk | Kernel | Ear Sheath | Ear Pith | Ear Stalk | Tassel |
|---|---|---|---|---|---|---|---|
| MZAS2007020377A005A-24a | day of pollination | 0 | 3 | 2 | 4 | 4 | ND |
| MZAS2007020377A005A-10 | day of pollination | 0 | 3 | 2 | 4 | 4 | 0 |
| MZAS2007020377A005A-2 | day of pollination | 0 | 3 | 2 | 4 | 4 | 0 |
| MZAS2007020377A005A-3 | 6 days after pollination | 0 | 3* | 2 | 3 | ND | ND |
| MZAS2007020377A005A-24b | 6 days after pollination | 0 | 3 | 2 | 4 | 4 | ND |
| MZAS2007020377A005A-16 | 10 days after pollination | 0 | 3* | 2 | 3 | ND | ND |
| MZAS2007020377A005A-18 | 10 days after pollination | 0 | 3* | 2 | 3 | ND | ND |
| MZAS2007020377A010A-16 | 5 days before pollination | ND | ND | 3 | 4 | 3 | 2 |
| MZAS2007020377A010A-21 | 5 days before pollination | ND | ND | ND | 4 | 3 | 0 |
| MZAS2007020377A010A-5 | day of pollination | 0 | 2 | 2 | 3 | 3 | 0 |
| MZAS2007020377A010A-20 | 6 days after pollination | 0 | 3* | 2 | 4 | ND | ND |
| MZAS2007020377A010A-6 | 6 days after pollination | 0 | 2* | 2 | 3 | 4 | ND |
| MZAS2007020377A010A-17 | 10 days after pollination | ND | 3* | 2 | 3 | ND | ND | legend
0 negative
1 very light blue
2 light blue
3 blue
4 dark blue
5 very dark blue
ND no data
*endosperm and embryo are negative The data provided here show that prZmHSP70 (SEQ ID NO: 1) is functional in most maize plant tissues.

Example 2

ZmUbi158

The ZmUbi158 GeneChip probe, CTRL_ZMU29158-3_AT (SEQ ID NO: 15), was used to identify corresponding cDNAs and gDNAs in genomic databases. The cDNAs identified include GenBank accession Q41751 (SEQ ID NO: 23). The gDNAs include GenBank accessions AC196154 (SEQ ID NO: 24) and 594466 (SEQ ID NO: 25), and maize genome sequence contig MAGI_6372 (SEQ ID NO: 26). These sequences were used to develop a base-level annotation of the ZmUbi158 gene (SEQ ID NO: 27). The ZmUbi158 gene comprises three exons separated by two introns. The sequence data were used to design an expression cassette following the method used to make the OsMADS expression cassettes as disclosed in US Patent Application Publication No. 2007/0006344, incorporated herein by reference in its entirety. Upstream of the gene of interest (GOI) the finished expression cassette comprises the ZmUbi158 promoter containing 1506 bp of 5'-non-transcribed sequence (SEQ ID NO: 45), a 163 bp 5'-untranslated leader sequence (SEQ ID NO: 46) and the 2386 bp ZmUbi158 first intron (SEQ ID NO: 48). The ZmUbi158 protein coding sequence was silenced by mutating translation start codons and altering other codons to insert translation stops upstream of the engineered translation start codon (at the NcoI) site. Downstream of the GOI the expression cassette comprises a terminator sequence (SEQ ID NO: 55) derived from the ZmUbi158 gene. It comprises a 341 bp 3'-untranslated sequence (SEQ ID NO: 49) that starts just past the translation stop codon plus 660 bp of 3'-non-transcribed ZmUbi158 sequence (SEQ ID NO: 50). SEQ ID NOs: 35 and 5 define the ZmUbi158 assembly and binary vectors, respectively. In both cases the ZmUbi158 expression cassette (SEQ ID NO: 11) comprises the β-glucuronidase (GUS) reporter gene.

The prZmUbi158 promoter (SEQ ID NO: 2) was designed as described above. The product was verified by restriction analysis and complete sequence analysis. The GUS coding sequence component was cloned into the expression cassette as an NcoI/SacI fragment. The cloning junctions were sequenced.

The ZmUbi158-GUS expression cassette (SEQ ID NO: 11) was excised from 17222 as an RsrII/SanDI fragment and ligated to the RsrII site in the recipient vector. The cloning junctions were sequenced.

The ZmUbi158 binary vector (SEQ ID NO: 5) was transformed into maize by *Agrobacterium* transformation, a technique well known in the art. Of the 35 events that were produced, 14 set seed. Table 5 summarizes the seed production data for these events. The GUS enzyme in young and fully expanded leaves was assayed by histochemical localization and ELISA. The T0 data are summarized in Table 5.

TABLE 5

GUS assay results for T0 plants.

| T0 Plant ID | ELISA[1] | ELISA[2] | GUS histochemical assay[3] |
|---|---|---|---|
| MZDT080326A001A | 17652 | 39984 | postive |
| MZDT080326A002A | 14592 | 26280 | postive |
| MZDT080326A003A | 476 | 1141 | negative |
| MZDT080326A005A | 21508 | 34883 | postive |

TABLE 5-continued

GUS assay results for T0 plants.

| T0 Plant ID | ELISA[1] | ELISA[2] | GUS histochemical assay[3] |
|---|---|---|---|
| MZDT080326A008A | 6212 | 28546 | postive |
| MZDT080326A009A | 34962 | 69172 | postive |
| MZDT080326A014A | 34337 | 56401 | postive |
| MZDT080326A024A | 33900 | 54698 | postive |
| MZDT080326A025A | 81941 | 36831 | postive |
| MZDT080326A026A | 2678 | 8222 | postive |
| MZDT080326A031A | 16524 | 30427 | postive |
| MZDT080326A032A | 29 | ND | negative |
| MZDT080326A033A | 27084 | 58994 | postive |
| MZDT080326A042A | 5127 | 19399 | postive |
| MZDT080326A043A | 38 | ND | negative |
| MZDT080326A046A | 11576 | 22534 | postive |
| MZDT080326A047A | 8478 | 45792 | postive |
| MZDT080326A052A | 14020 | 45121 | postive |
| MZDT080326A053A | 12904 | 41312 | postive |
| MZDT080326A061A | 2474 | 5904 | postive |
| MZDT080326A064A | 7407 | 39874 | postive |
| MZDT080326A068A | 9349 | 18439 | postive |
| MZDT080326A072A | 7937 | 40374 | postive |
| MZDT080326A076A | 8571 | 24114 | postive |
| MZDT080326A079A | 9520 | ND | ND |
| MZDT080326A080A | 14627 | 25151 | postive |
| MZDT080326A082A | 11389 | 41792 | postive |
| MZDT080326A088A | 13597 | 56406 | postive |
| MZDT080326A089A | 11499 | 33423 | postive |
| MZDT080326A094A | 10392 | 46578 | postive |
| MZDT080326A099A | 6037 | 30037 | postive |
| MZDT080326A101A | 7296 | 46100 | postive |
| MZDT080326A103A | 4115 | 39834 | postive |
| MZDT080326A104A | 6241 | 22930 | postive |

[1] GUS as ng/mg of soluble protein from V6 leaf tissue.
[2] GUS as ng/mg of soluble protein from V12 leaf tissue.
[3] Leaf tissue was incubated in histochemical staining reagent overnight at 37 C. then cleared and scored as positive or negative.

Table 6 summarizes T1/B1 GUS assay data for tissue of plants containing the ZmUbi158-GUS expression cassette.

TABLE 6

T1/B1 GUS assay data for tissue of plants containing the ZmUbi158-GUS expression cassette.

| T1/F1 Plant ID | GUS zygosity | Sampling Stage | Source Tissue — root | Source Tissue — stem just above the root | Source Tissue — ear node | Source Tissue — node beneath the ear node | Tissue Treatment in GUS Reagent[1] |
|---|---|---|---|---|---|---|---|
| A042A-16 | Het | 5 days pre-pollination | 5 | 4 | 4 | 4 | A |
| A042A-10 | Hom | 6 days pre-pollination | 4 | 4 | 4 | 4 | B |
| A053A-23 | Het | 5 days pre-pollination | 4 | 4 | 4 | 4 | C |
| A053A-12 | Het | 5 days pre-pollination | 5 | 4 | 4 | 4 | B |
| A072A-8 | Hom | 3 days pre-pollination | 4 | 4 | 3 | 4 | B |
| A072A-23 | Het | 5 days pre-pollination | 4 | 4 | 4 | 4 | B |
| A072A-1 | Het | on the day of pollination | 4 | 4 | 4 | 4 | B |
| A042A-11 | Hom | 6 days after pollination | 5 | 4 | 4 | 4 | D |
| A042A-15 | Het | 7 days after pollination | 4 | 4 | 3 | 4 | C |
| A053A-18 | Het | 7 days after pollination | 4 | 4 | 4 | 4 | E |
| A053A-21 | Het | 7 days after pollination | 4 | 4 | 4 | 4 | B |
| A072A-18 | Het | 5 days after pollination | 5 | 4 | 4 | 4 | B |
| A072A-25 | Het | 5 days after pollination | 5 | 4 | 4 | 4 | B |
| A042A-18 | Het | 12 days after pollination | 5 | 4 | 3 | 4 | B |
| A042A-22 | Hom | 16 days after pollination | 4 | 4 | 5 | 4 | F |
| A042A-25 | Het | 17 days after pollination | 4 | 4 | 4 | 4 | B |
| A053A-20 | Hom | 16 days after pollination | 4 | 3 | 3 | 4 | G |
| A053A-15 | Het | 15 days after pollination | 4 | 4 | 4 | 4 | B |
| A053A-28 | Het | 19 days after polination | 4 | 3 | 3 | 4 | B |
| A072A-27 | Hom | 15 days after pollination | 5 | 4 | 3 | 4 | B |
| A072A-6 | Het | 17 days after pollination | 5 | 3 | 3 | 3 | B |
| A072A-26 | Het | 23 days after pollination | 4 | 4 | 3 | 3 | B |

| T1/F1 Plant ID | GUS zygosity | Sampling Stage | Source Tissue — stem beneath the tassel branch | Source Tissue — ear leaf | Source Tissue — tassel leaf | Source Tissue — ear husk | Tissue Treatment in GUS Reagent[1] |
|---|---|---|---|---|---|---|---|
| A042A-16 | Het | 5 days pre-pollination | 3 | 1 | 1 | 5 | A |
| A042A-10 | Hom | 6 days pre-pollination | 3 | 3 | 3 | 5 | B |
| A053A-23 | Het | 5 days pre-pollination | 3 | 3 | 2 | 5 | C |
| A053A-12 | Het | 5 days pre-pollination | 3 | 1 | 1 | 5 | B |
| A072A-8 | Hom | 3 days pre-pollination | 3 | 2 | 2 | 5 | B |
| A072A-23 | Het | 5 days pre-pollination | 3 | 1 | 1 | 5 | B |
| A072A-1 | Het | on the day of pollination | 3 | 2 | 2 | 5 | B |
| A042A-11 | Hom | 6 days after pollination | 3 | 3 | 3 | 5 | D |
| A042A-15 | Het | 7 days after pollination | 3 | 3 | 3 | 5 | C |
| A053A-18 | Het | 7 days after pollination | 3 | 2 | 3 | 5 | E |
| A053A-21 | Het | 7 days after pollination | 3 | 3 | 2 | 5 | B |
| A072A-18 | Het | 5 days after pollination | 3 | 2 | 2 | 5 | B |
| A072A-25 | Het | 5 days after pollination | 3 | 2 | 2 | 5 | B |

TABLE 6-continued

T1/B1 GUS assay data for tissue of plants containing the ZmUbi158-GUS expression cassette.

| A042A-18 | Het | 12 days after pollination | 3 | 1 | 1 | 5 | B |
| A042A-22 | Hom | 16 days after pollination | 3 | 3 | 2 | 5 | F |
| A042A-25 | Het | 17 days after pollination | 4 | 1 | 1 | 5 | B |
| A053A-20 | Hom | 16 days after pollination | 3 | 1 | 1 | 5 | G |
| A053A-15 | Het | 15 days after pollination | 3 | 2 | 1 | 5 | B |
| A053A-28 | Het | 19 days after polination | 3 | 2 | 2 | 5 | B |
| A072A-27 | Hom | 15 days after pollination | 3 | 1 | 1 | 4 | B |
| A072A-6 | Het | 17 days after pollination | 3 | 1 | 1 | 5 | B |
| A072A-26 | Het | 23 days after pollination | 3 | 1 | 1 | 5 | B |

| T1/F1 Plant ID | GUS zygosity | Sampling Stage | Source Tissue silk | tassel | ear | Tissue Treatment in GUS Reagent[1] |
|---|---|---|---|---|---|---|
| A042A-16 | Het | 5 days pre-pollination | 3 | 1 | 4 | A |
| A042A-10 | Hom | 6 days pre-pollination | 2 | 1 | 3 | B |
| A053A-23 | Het | 5 days pre-pollination | 2 | 1 | 3 | C |
| A053A-12 | Het | 5 days pre-pollination | 3 | 1 | 4 | B |
| A072A-8 | Hom | 3 days pre-pollination | 3 | 2 | 3 | B |
| A072A-23 | Het | 5 days pre-pollination | 3 | 2 | 4 | B |
| A072A-1 | Het | on the day of pollination | 2 | 1 | 3 | B |
| A042A-11 | Hom | 6 days after pollination | 2 | 2 | 4 | D |
| A042A-15 | Het | 7 days after pollination | 2 | 2 | 5 | C |
| A053A-18 | Het | 7 days after pollination | 3 | 2 | 5 | E |
| A053A-21 | Het | 7 days after pollination | 3 | 2 | 4 | B |
| A072A-18 | Het | 5 days after pollination | 2 | 2 | 4 | B |
| A072A-25 | Het | 5 days after pollination | 2 | 2 | 5 | B |
| A042A-18 | Het | 12 days after pollination | 3 | 2 | 3 | B |
| A042A-22 | Hom | 16 days after pollination | 3 | 2 | 3 | F |
| A042A-25 | Het | 17 days after pollination | 3 | 2 | 3 | B |
| A053A-20 | Hom | 16 days after pollination | 3 | 2 | 3 | G |
| A053A-15 | Het | 15 days after pollination | 3 | 2 | 3 | B |
| A053A-28 | Het | 19 days after polination | 2 | 1 | 4 | B |
| A072A-27 | Hom | 15 days after pollination | 2 | 2 | 3 | B |
| A072A-6 | Het | 17 days after pollination | 3 | 2 | 3 | B |
| A072A-26 | Het | 23 days after pollination | 4 | 2 | 4 | B | legend: 0 = negative; 1 = very light blue; 2 = light blue; 3 = blue; 4 = dark blue; 5 = very dark blue.

[1]A indicates all tissues incubated at room temp for 7 hours; B indicates all tissues incubated at 37 C. for 16 hours; C indicates ear leaf, tassel leaf, ear husk, silk, tassel incubated at 37 C. for 16 hours, other tissues incubated at room temperature for 5 hours; D indicates ear leaf, tassel leaf, ear husk, silk, tassel incubated at 37 C. for 16 hours, other tissues incubated at room temperature for 6 hours; E indicates ear leaf, tassel leaf, ear husk, silk, tassel incubated at 37 C. for 16 hours, other tissues incubated at room temperature for 4 hours; F indicates ear leaf, tassel leaf, ear husk incubated at 37 C. for 16 hours, other tissues incubated at room temperature for 5 hours; G indicates ear leaf, tassel leaf, ear husk incubated at 37 C. for 16 hours, other tissues incubated at room temperature for 7 hours The data presented in Table 6 show that prZmUbi158 (SEQ ID NO: 2) is functional in maize plant tissue which comprises SEQ ID NO: 2.

Example 3

ZmUbi361

The ZmUbi361 GeneChip probe, ZM066361_S_AT (SEQ ID NO: 16), was used to identify corresponding cDNAs and gDNAs in genomic databases. The cDNAs identified include TIGR accession TC369342-cDNA (SEQ ID NO: 28). The gDNAs include GenBank accessions AC196194 (SEQ ID NO: 29) and U29162.1 (SEQ ID NO: 30), and maize genome sequence contigs MAGI_11628 (SEQ ID NO: 31) and MAGI_56231 (SEQ ID NO: 32). These sequences were used to develop a base-level annotation of the ZmUbi361 gene (SEQ ID NO: 33). The ZmUbi361 gene comprises two exons separated by one intron. The sequence data were used to design an expression cassette following the method used to make the OsMADS expression cassettes as disclosed in US Patent Application Publication No. 2007/0006344, incorporated herein by reference in its entirety. Upstream of the gene of interest (GOI) the finished expression cassette comprises the ZmUbi361 promoter containing 1501 bp of 5'-non-transcribed sequence (SEQ ID NO: 51), a 260 bp 5'-untranslated leader sequence (SEQ ID NO: 52) that contains the tobacco etch virus omega translational enhancer (SEQ ID NO: 47) and terminates in a maize-optimized Kozak sequence (ataaaccatgg) (SEQ ID NO: 8) and the 1329 bp ZmUbi361 intron (SEQ ID NO: 53). The ZmUbi361 protein coding sequence was silenced by mutating translation start codons and altering other codons to insert translation stops upstream of the engineered translation start codon (at the NcoI site. Downstream of the GOI the expression cassette comprises a terminator sequence (SEQ ID NO: 54) derived from the ZmUbi361 gene. It comprises a 65 bp 3'-untranslated sequence (SEQ ID NO: 56) that starts just past the translation stop codon plus 936 bp of 3'-non-transcribed ZmUbi361 sequence (SEQ ID NO: 57). SEQ ID NOs: 36 and 6 define the ZmUbi361 assembly and binary vectors, respectively. In both cases the ZmUbi361 expression cassette (SEQ ID NO: 12) comprises the β-glucuronidase (GUS) reporter gene.

The prZmUbi361 expression cassette (SEQ ID NO: 12) was designed as above and synthesized, supplied in pCR4-TOPO (SEQ ID NO: 58). SEQ ID NO: 12 was excised as a SanDI/RsrII fragment and ligated to the backbone of SEQ ID NO: 35. The GUS sequence was excised from pNOV6901 as an NcoI/SacI fragment and ligated to the ZmUbi361 expression cassette.

The prZmUbi361 expression cassette (SEQ ID NO: 12) was excised from 17267 as a SanDI/RsrII fragment and ligated to the RsrII site in the recipient vector.

The ZmUbi361 binary vector (SEQ ID NO: 6) was transformed into maize by transformation methods well known in the art. Of the 36 events that were produced, 21 set seed. Table 7 summarizes the seed production and genotyping data for these events. The GUS transcript (mRNA) was also quantified in young leaf tissue. The GUS enzyme in fully expanded leaves was assayed by histochemical localization and ELISA. The T0 data are summarized in Table 7.

TABLE 7

Seed production and GUS histochemical data for ZmUbi361.

| T0 ID | qRT-PCR mean[1] | qRT-PCR StDev | ELISA[2] | GUS histochemical assay[3] |
|---|---|---|---|---|
| MZDT080370A004A | 11678 | 868 | 33369 | + |
| MZDT080370A005A | 2702 | 435 | 25468 | + |
| MZDT080370A009A | 27070 | 5245 | 22803 | ND |
| MZDT080370A010A | 5222 | 1796 | 25946 | + |
| MZDT080370A013A | 1824 | 2818 | 0 | − |
| MZDT080370A014A | 7057 | 1583 | 20540 | + |
| MZDT080370A015A | 12765 | 3402 | 10339 | + |
| MZDT080370A016A | 5653 | 3607 | 23552 | + |
| MZDT080370A017A | 20439 | 4158 | 22196 | + |
| MZDT080370A018A | 281 | 1615 | 83 | ND |
| MZDT080370A019A | 30303 | 8344 | 13361 | + |
| MZDT080370A023A | 3622 | 2775 | 27224 | ND |
| MZDT080370A026A | 12051 | 4177 | 10999 | + |
| MZDT080370A037A | 9136 | 4081 | 17909 | + |
| MZDT080370A037A | 9136 | 4081 | 17909 | + |
| MZDT080370A042A | 8976 | 1526 | 0 | − |
| MZDT080370A054A | 2232 | 1285 | 62 | ND |
| MZDT080370B003A | 1861 | 1846 | 8477 | + |
| MZDT080370B004A | 1844 | 878 | 15541 | ND |
| MZDT080370B006A | 2786 | 444 | 2470 | − |
| MZDT080370B007A | 2655 | 1917 | 12099 | + |
| MZDT080370B011A | 1588 | 904 | 13895 | + |
| MZDT080370B012A | 1025 | 188 | 119 | ND |
| MZDT080370B015A | 2746 | 494 | 13559 | + |
| MZDT080370B023A | 583 | 183 | 411 | ND |
| MZDT080370B027A | 2803 | 232 | 8789 | + |
| MZDT080370B030A | 279 | 313 | 2348 | + |
| MZDT080370B034A | 2008 | 387 | 15532 | + |
| MZDT080370B037A | 59 | 27 | 7020 | + |

[1]relative expression to endogenous control (elongation factor 2α)
[2]GUS as ng/mg of soluble protein
[3]scored positive (+) or negative (−); "ND" is no data T1 plants representing three events were analyzed to determine expression cassette performance of cassettes comprising the ZmUbi361 promoter. The experimental approach consisted of two studies, a seedling assay and a developmental study. Both root and leaf tissue of T1/B1 seedlings were analyzed for GUS protein accumulation.

GUS reporter protein data for T1/F1 seedlings comprising ZmUbi361 are in Table 8.

TABLE 8

| | Leaf | | Root | |
|---|---|---|---|---|
| Seedling Plant ID | qRT-PCR[1] GUS Mean | GUS ELISA[2] | qRT-PCR[1] GUS Mean | GUS ELISA[2] |
| MZDT080370A004A-49 | 7979 | 30845 | 1571 | 80553 |
| MZDT080370A004A-52 | 11407 | 30000 | 1479 | 58166 |
| MZDT080370A004A-53 | 3826 | 23497 | 498 | 39054 |
| MZDT080370A004A-56 | 4802 | 36565 | 308 | 44148 |
| MZDT080370A004A-58 | 11687 | 34059 | 629 | 124694 |
| MZDT080370A004A-60 | 1877 | 23301 | 220 | 42975 |
| MZDT080370A004A-62 | 2291 | 25754 | 225 | 18024 |
| MZDT080370A004A-63 | 2192 | 27141 | 186 | 24458 |
| MZDT080370A019A-49 | 1043 | 20846 | 116 | 35386 |
| MZDT080370A019A-51 | 4429 | 30342 | 120 | 47939 |
| MZDT080370A019A-57 | 2806 | 20302 | 221 | 33528 |
| MZDT080370A019A-58 | 2744 | 30727 | 832 | 66695 |
| MZDT080370A019A-61 | 3024 | 23475 | 203 | 33301 |
| MZDT080370A037A-49 | 1923 | 23776 | 55 | 35314 |
| MZDT080370A037A-51 | 4284 | 37580 | 246 | 62985 |
| MZDT080370A037A-57 | 1810 | 20640 | 182 | 22194 |
| MZDT080370A037A-58 | 3121 | 31546 | 468 | 56957 |
| MZDT080370A037A-59 | 1660 | 18300 | 129 | 23270 |

[1]relative units
[2]ng GUS/mg soluble protein

The developmental study demonstrates the spatial accumulation of GUS protein throughout the plant. To do this plants were sampled at three stages, early reproductive development, or R1 (Ritchie et al., 1992), post pollination or R2 and later reproductive development (R3). Several plant parts were analyzed using histochemistry. The data suggest that ZmUbi158 is less active in reproductive tissue relative to vegetative tissue, however it is active in pollen.

Data for developmental expression of T1 maize carrying the ZmUbi361 expression cassette are in Tables 9A-9D. These data indicate that ZmUbi361 is more active in root relative to leaf. The quantitative performance of ZmUbi361 is 2-4 times greater than that of ZmUbi158. At the low end GUS protein accumulation represents 0.5% of soluble protein and at the high end it is 4% of extractable protein in single copy seedlings.

TABLE 9A

Plants at V8 Stage.

| Sample ID | qRT-PCR GUS Mean | ELISA (ng GUS/mg soluble protein) |
|---|---|---|
| MZDT080370A004A-48 root leaf | 845 | 56546 |
| MZDT080370A004A-48 ear leaf | 851 | 71000 |
| MZDT080370A004A-48 tassel leaf | 556 | 45100 |
| MZDT080370A004A-48 root | 693 | 24328 |
| MZDT080370A004A-34 root leaf | 1639 | 51070 |
| MZDT080370A004A-34 ear leaf | 1747 | 57133 |
| MZDT080370A004A-34 tassel leaf | 1044 | 49186 |
| MZDT080370A004A-34 root | 372 | 59888 |
| MZDT080370A019A-24 root leaf | 1328 | 53738 |
| MZDT080370A019A-24 ear leaf | 837 | 34582 |
| MZDT080370A019A-24 tassel leaf | 1023 | 47660 |
| MZDT080370A019A-24 root | 188 | 33632 |
| MZDT080370A019A-25 root leaf | 1116 | 74705 |
| MZDT080370A019A-25 ear leaf | 744 | 76802 |
| MZDT080370A019A-25 tassel leaf | 1051 | 46546 |
| MZDT080370A019A-25 root | 104 | 29022 |
| MZDT080370A037A-10 root leaf | 252 | 21606 |
| MZDT080370A037A-10 full | 374 | 35817 |
| MZDT080370A037A-10 old | 567 | 61477 |
| MZDT080370A037A-10 root | 78 | 6514 |
| MZDT080370A037A-26 root leaf | 527 | 33135 |
| MZDT080370A037A-26 ear leaf | 500 | 56219 |
| MZDT080370A037A-26 tassel leaf | 432 | 26537 |
| MZDT080370A037A-26 root | 135 | 2202 |

TABLE 9B

Plants at Pre-Pollination Stage.

| Sample ID | qRT-PCR GUS Mean | ELISA (ng GUS/mg soluble protein) |
|---|---|---|
| MZDT080370A004A-17 root leaf | 1540 | 88938 |
| MZDT080370A004A-17 ear leaf | 1147 | 64255 |
| MZDT080370A004A-17 tassel leaf | 1351 | 69176 |
| MZDT080370A004A-17 root | 1471 | 41086 |
| MZDT080370A004A-19 root leaf | 758 | 94022 |
| MZDT080370A004A-19 ear leaf | 2083 | 131137 |
| MZDT080370A004A-19 tassel leaf | 1921 | 106673 |
| MZDT080370A004A-19 root | 1583 | 50402 |
| MZDT080370A019A-1 root leaf | 813 | 118209 |
| MZDT080370A019A-1 ear leaf | 1006 | 102875 |
| MZDT080370A019A-1 tassel leaf | 980 | 109279 |
| MZDT080370A019A-1 root | 479 | 32582 |
| MZDT080370A019A-8 root leaf | 1484 | 121832 |
| MZDT080370A019A-8 ear leaf | 1143 | 93884 |
| MZDT080370A019A-8 tassel leaf | 179 | 14178 |
| MZDT080370A019A-8 root | 842 | 51992 |
| MZDT080370A037A-8 root leaf | 335 | 44419 |
| MZDT080370A037A-8 ear leaf | 398 | 46079 |
| MZDT080370A037A-8 tassel leaf | 747 | 41610 |
| MZDT080370A037A-8 root | 811 | 20363 |
| MZDT080370A037A-9 root leaf | 877 | 30356 |
| MZDT080370A037A-9 ear leaf | 224 | 37169 |
| MZDT080370A037A-9 tassel leaf | 1021 | 50858 |
| MZDT080370A037A-9 root | 640 | 20298 |

TABLE 9C

Plants at 9 Days Post-Pollination.

| Sample ID | qRT-PCR GUS Mean | ELISA (ng GUS/mg soluble protein) |
|---|---|---|
| MZDT080370A004A-2 root leaf | 865 | 182913 |
| MZDT080370A004A-2 ear leaf | 635 | 99395 |
| MZDT080370A004A-2 tassel leaf | 232 | 113087 |
| MZDT080370A004A-2 root | 178 | 37983 |
| MZDT080370A004A-14 root leaf | 306 | 87502 |
| MZDT080370A004A-14 ear leaf | 497 | 126152 |
| MZDT080370A004A-14 tassel leaf | 387 | 68053 |
| MZDT080370A004A-14 root | 310 | 58438 |
| MZDT080370A019A-28 root leaf | 528 | 45088 |
| MZDT080370A019A-28 ear leaf | 405 | 105005 |
| MZDT080370A019A-28 tassel leaf | 284 | 45817 |
| MZDT080370A019A-28 root | 148 | 33118 |
| MZDT080370A019A-35 root leaf | 564 | 56323 |
| MZDT080370A019A-35 ear leaf | 632 | 53113 |
| MZDT080370A019A-35 tassel leaf | 507 | 108954 |
| MZDT080370A019A-35 root | 300 | 40700 |
| MZDT080370A037A-2 root leaf | 274 | 53902 |
| MZDT080370A037A-2 ear leaf | 404 | 35963 |
| MZDT080370A037A-2 tassel leaf | 195 | 33632 |
| MZDT080370A037A-2 root | 32 | 15491 |
| MZDT080370A037A-41 root leaf | 269 | 44580 |
| MZDT080370A037A-41 ear leaf | 273 | 25548 |
| MZDT080370A037A-41 tassel leaf | 199 | 30534 |
| MZDT080370A037A-41 root | 77 | 27373 |

TABLE 9D

Plants at 17 Days Post-Pollination.

| Sample ID | qRT-PCR GUS Mean | ELISA (ng GUS/mg soluble protein) |
|---|---|---|
| MZDT080370A004A-15 ear leaf | 2026 | 64833 |
| MZDT080370A004A-15 tassel leaf | 1102 | 54330 |
| MZDT080370A004A-15 root leaf | 591 | 47710 |
| MZDT080370A004A-15 root | 410 | 11077 |
| MZDT080370A004A-25 tassel leaf | 1103 | 43762 |
| MZDT080370A004A-25 ear leaf | 1583 | 48255 |
| MZDT080370A004A-25 root leaf | 1283 | 52271 |
| MZDT080370A004A-25 root | 714 | 24261 |
| MZDT080370A019A-32 tassel leaf | 568 | 39362 |
| MZDT080370A019A-32 ear leaf | 1318 | 27806 |
| MZDT080370A019A-32 root leaf | 769 | 47079 |
| MZDT080370A019A-32 root | 473 | 40498 |
| MZDT080370A019A-38 tassel leaf | 664 | 39359 |
| MZDT080370A019A-38 ear leaf | 1171 | 40362 |
| MZDT080370A019A-38 root leaf | 807 | 34531 |
| MZDT080370A019A-38 root | 197 | 22722 |
| MZDT080370A037A-1 tassel leaf | 409 | 23226 |
| MZDT080370A037A-1 ear leaf | 622 | 17211 |
| MZDT080370A037A-1 root leaf | 691 | 28706 |
| MZDT080370A037A-1 root | 104 | 27698 |
| MZDT080370A037A-39 tassel leaf | 444 | 27268 |
| MZDT080370A037A-39 ear leaf | 943 | 23569 |
| MZDT080370A037A-39 root leaf | 600 | 36720 |
| MZDT080370A037A-39 root | 421 | 17805 |

Example 5

Promoter Functionality in a Dicot

SEQ ID NOs: 2 and 3 were tested in tobacco plants to determine if these promoters, which were designed from monocot genes, would function as promoters in dicots. Tobacco is a model organism and is useful as a predictor of how expression cassettes will perform in other dicot plants, such as soybean.

The prZmUbi158-GUS expression cassette (SEQ ID NO: 11) from plasmid 17222 (SEQ ID NO: 35) was restriction enzyme digested with SanDI and RsrII and subsequently cloned into the RsrII site of binary vector 17680 (SEQ ID NO: 59) to create vector 18271 (SEQ ID NO: 60). SEQ ID NO: 60 was transformed into tobacco via *Agrobacterium*-mediated transformation. The performance of prZmUbi158 in T0 tobacco plants is recorded in Table 10, below. As the data indicate, prZmUbi158, while retaining some function, was not a highly active promoter in tobacco.

TABLE 10 prZmUbi158 functionality in T0 tobacco plants.

| T0 Plant ID | qRT-PCR[1] GUS mean | ELISA[2] GUS mean |
|---|---|---|
| TBUK095101A003A | 393.6 | ND |
| TBUK095101A004A | 778.3 | ND |
| TBUK095101A005A | 1191.3 | ND |
| TBUK095101A009A | 490.6 | ND |
| TBUK095101A010A | 659.0 | ND |
| TBUK095101A011A | 789.9 | ND |
| TBUK095101A012A | 432.1 | ND |
| TBUK095101A013A | 618.5 | 41.1 |
| TBUK095101A014A | 572.5 | ND |
| TBUK095101A015A | 1161.9 | 10.3 |

TABLE 10-continued prZmUbi158 functionality in T0 tobacco plants.

| T0 Plant ID | qRT-PCR[1] GUS mean | ELISA[2] GUS mean |
|---|---|---|
| TBUK095101A016A | 328.1 | ND |
| TBUK095101A019A | 502.0 | 65.4 |
| TBUK095101A020A | 444.8 | ND |
| TBUK095101A029A | 1504.7 | 49.0 |
| TBUK095101A030A | 479.4 | 24.9 |
| TBUK095101A031A | 826.2 | ND |
| TBUK095101A032A | 399.4 | ND |
| TBUK095101A035A | 910.9 | ND |
| TBUK095101A036A | 502.1 | 23.9 |
| TBUK095101A038A | 2375.3 | 108.8 |
| TBUK095101A040A | 633.9 | ND |
| TBUK095101A042A | 328.4 | ND |
| TBUK095101A043A | 0.0 | ND |
| TBUK095101A044A | 423.5 | ND |
| TBUK095101A048A | 533.2 | ND |
| TBUK095101A052A | 561.1 | ND |
| TBUK095101A053A | 802.3 | ND |
| TBUK095101A054A | 0.0 | ND |
| TBUK095101A055A | 414.0 | ND |
| TBUK095101A056A | 1015.8 | ND |
| TBUK095101A057A | 773.5 | ND |
| TBUK095101A058A | 516.6 | 47.3 |
| TBUK095101A061A | 507.4 | ND |
| TBUK095101A062A | 478.8 | 79.5 |
| TBUK095101A073A | 335.5 | ND |
| TBUK095101A074A | 152.6 | ND |
| TBUK095101A077A | 665.6 | 777.9 |
| TBUK095101A078A | 374.5 | ND |
| TBUK095101A080A | 802.1 | 78.5 |
| TBUK095101A083A | 1063.9 | 14.9 |
| TBUK095101A085A | ND | ND |
| TBUK095101A093A | 604.1 | ND |
| TBUK095101A097A | 878.3 | 30.1 |
| TBUK095101A105A | 1410.2 | 90.2 |
| TBUK095101A106A | 448.7 | ND |
| TBUK095101A107A | 1101.8 | ND |

[1]relative units
[2]ng GUS/mg soluble protein

The prZmUbi361-GUS expression cassette (SEQ ID NO: 12) from plasmid 17267 (SEQ ID NO: 36) was restriction enzyme digested with SanDI and RsrII and subsequently cloned into the RsrII site of binary vector 17680 (SEQ ID NO: 59) to create vector 18272 (SEQ ID NO: 61). SEQ ID NO: 61 was transformed into tobacco via *Agrobacterium*-mediated transformation. The performance of prZmUbi361 in T0 tobacco plants is recorded in Table 11, below. As the data indicate, prZmUbi361 was highly active in tobacco. These data show that prZmUbi361 is a desirable promoter to use in dicot plants as well as monocot plants.

TABLE 11 prZmUbi361 functionality in T0 tobacco.

| T0 Plant ID | qRT-PCR[1] GUS mean | ELISA[2] GUS mean |
|---|---|---|
| TBUK094700A001A | 5856.2 | 10842.2 |
| TBUK094700A002A | 6881.8 | 7207.2 |
| TBUK094700A005A | 12766.1 | 12169.3 |
| TBUK094700A006A | 9091.4 | 8875.0 |
| TBUK094700A007A | 5113.1 | 9564.3 |
| TBUK094700A008A | 5522.6 | 11472.5 |
| TBUK094700A013A | 11268.9 | 5118.4 |
| TBUK094700A015A | 4844.7 | 4285.6 |
| TBUK094700A018A | 4786.9 | 2226.1 |

TABLE 11-continued prZmUbi361 functionality in T0 tobacco.

| T0 Plant ID | qRT-PCR[1] GUS mean | ELISA[2] GUS mean |
|---|---|---|
| TBUK094700A029A | 8553.3 | 7242.9 |
| TBUK094700A030A | 3914.4 | 7201.3 |
| TBUK094700A031A | 5015.4 | 7552.5 |
| TBUK094700A032A | 4346.7 | 8058.6 |
| TBUK094700A033A | 5864.9 | 7257.5 |
| TBUK094700A034A | 10132.3 | 4906.8 |
| TBUK094700A036A | 3564.0 | 5246.3 |
| TBUK094700A037A | 342.1 | 321.4 |
| TBUK094700A040A | 1433.7 | 1445.2 |
| TBUK094700A041A | 6469.6 | 8130.8 |
| TBUK094700A042A | 7879.8 | 6893.7 |
| TBUK094700A044A | 8446.7 | 8175.6 |
| TBUK094700A045A | 2213.9 | 7705.1 |
| TBUK094700A046A | 6353.3 | 11685.4 |
| TBUK094700A047A | 4208.4 | 7426.4 |
| TBUK094700A049A | 3256.9 | 8271.0 |
| TBUK094700A051A | 5179.8 | 5079.5 |
| TBUK094700A054A | 3143.6 | 11610.8 |
| TBUK094700A057A | 1190.2 | 4514.2 |
| TBUK094700A060A | 7388.2 | 9830.9 |
| TBUK094700A064A | 15573.6 | 15832.6 |
| TBUK094700A065A | 1604.9 | 7166.2 |
| TBUK094700A072A | 3554.8 | 7492.6 |
| TBUK094700A073A | 5245.1 | 7534.7 |
| TBUK094700A074A | 3974.3 | 8657.1 |
| TBUK094700A079A | 3035.4 | 7916.9 |
| TBUK094700A081A | 3110.6 | 5416.6 |
| TBUK094700A082A | 5251.6 | 9757.1 |
| TBUK094700A084A | 4574.1 | 8151.2 |
| TBUK094700A088A | 4382.5 | 8554.8 |
| TBUK094700A089A | 2358.4 | 11864.6 |
| TBUK094700A090A | 3696.9 | 8756.8 |
| TBUK094700A091A | 4549.6 | 8392.9 |
| TBUK094700A092A | 2043.6 | 712.4 |
| TBUK094700A096A | 186.8 | ND |
| TBUK094700A097A | 3204.9 | 13351.1 |
| TBUK094700A104A | 1182.5 | 1390.8 |

[1]relative units
[2]ng GUS/mg soluble protein

Example 6

Promoter Optimization

SEQ ID NOs: 1-3 are modified sequentially to delete from the 5' region, and by every 200 bp, a portion of the original promoter sequence. The deletions are done using methods well known to one skilled in the art, including PCR, mutagenesis, and gene synthesis. The series of deletions are then ligated to binary vectors digested with XhoI/NcoI, respectively, to replace the original promoters. The new promoter fragment:GUS constructs are introduced into monocots and dicots using the transient assay method described in U.S. Provisional Patent Application No. 61/186,025, incorporated herein by reference in its entirety, and by *Agrobacterium tumefaciens* mediated transformation to generate transgenic plants.

GUS expression in these transgenic plants are assayed by activity assay and histochemical assay in both root and leaf tissues as described above. By comparing GUS activities in various deletion constructs and the original promoter constructs, the 5' fragments conferring functional promoter activity are identified as functional promoter fragments and sorted based on size. The smallest functional promoter fragment of the original promoter sequence is thereby determined.

A series of base substitutions in the smallest functional promoter fragments are then generated by direct chemical gene synthesis. Additionally, unwanted start codons are thereby silenced. These mutants are cloned to generate another set of promoter:GUS constructs. GUS expression of these constructs in transgenic plants is measured determined using the methods described above. Essential domains within the smallest functional fragments, wherein base substitutions abolish promoter activity, are thereby determined.

Expression cassettes may also be optimized by removing or adding transcriptional and translational enhancers. By way of example and not limitation, the expression cassette comprises a promoter selected from the group consisting of SEQ ID NOs: 1, 2, and 3. By way of further example, the expression cassette further comprises the transcriptional enhancers eFMV (nucleotides 306-499 of SEQ ID NO: 6) and e35S (nucleotides 506-798 of SEQ ID NO: 6) immediately upstream of the promoter. By way of further example, the expression cassette further comprises the TMV-omega translational enhancer (SEQ ID NO: 7) immediately downstream of the promoter. By way of further example, the expression cassette further comprises a Kozak sequence (SEQ ID NO: 8 or SEQ ID NO: 9) immediately upstream of the start codon of the gene of interest.

CONCLUSION

In view of the results provided here, it is an object of the present invention to provide nucleic acid, preferably an isolated nucleic acid, capable of driving expression in a plant cell, wherein the nucleic acid sequence comprises a 5'-untranslated region, a first exon, a first intron, and a portion of a second exon of a gene represented by a sequence selected from the group consisting of SEQ ID NOs: 13-33. The invention further relates to the nucleic acid sequence which is selected from the group consisting of SEQ ID NOs: 1-3. In another aspect, the plant cell comprising the nucleic acid can be a monocot cell or a dicot cell. In yet another aspect, the plant cell comprising the nucleic acid can be a maize cell or a tobacco cell.

In another aspect, one object of the present invention is to relate a method of expressing a heterologous gene comprising constructing an expression cassette comprising a promoter selected from the group comprising prZmHSP70 (SEQ ID NO: 1), prZmUbi158 (SEQ ID NO: 2), and prZmUbi361 (SEQ ID NO: 3), wherein the expression cassette is functional in a plant, plant cell, or plant tissue or portion thereof; and creating a plant, plant cell, or plant tissue or portion thereof comprising the expression cassette, wherein the heterologous gene is expressed. The invention further relates to expressing the heterologous gene in a plant, plant cell, or plant tissue or portion thereof wherein the plant, plant cell, or plant tissue or portion thereof is a monocot. The invention further relates to expressing the heterologous gene in a plant, plant cell, or plant tissue or portion thereof wherein the plant, plant cell, or plant tissue or portion thereof is maize. The invention further relates to expressing the heterologous gene in a plant, plant cell, or plant tissue or portion thereof wherein the plant, plant cell, or plant tissue or portion thereof is a dicot. The invention further relates to expressing the heterologous gene in a plant, plant cell, or plant tissue or portion thereof wherein the plant, plant cell, or plant tissue or portion thereof is tobacco or soybean.

The present invention also relates to a plant, plant cell, or plant tissue or portion thereof comprising an expression cassette comprising a promoter selected from the group comprising prZmHSP70 (SEQ ID NO: 1), prZmUbi158 (SEQ ID NO: 2), and prZmUbi361 (SEQ ID NO: 3). The invention further relates to the plant, plant cell, or plant tissue or portion thereof comprising the expression cassette, wherein the wherein the plant, plant cell, or plant tissue or portion thereof is a monocot. The invention further relates to the plant, plant cell, or plant tissue or portion thereof comprising the expression cassette, wherein the wherein the plant, plant cell, or plant tissue or portion thereof is maize. The invention further relates to the plant, plant cell, or plant tissue or portion thereof comprising the expression cassette, wherein the wherein the plant, plant cell, or plant tissue or portion thereof is a dicot. The invention further relates to the plant, plant cell, or plant tissue or portion thereof comprising the expression cassette, wherein the wherein the plant, plant cell, or plant tissue or portion thereof is tobacco or soybean.

The present invention also relates to an expression cassette comprising a promoter selected from the group comprising prZmHSP70 (SEQ ID NO: 1), prZmUbi158 (SEQ ID NO: 2), and prZmUbi361 (SEQ ID NO: 3).

The present invention further relates to a plant, plant cell, or plant tissue or portion thereof made by the method of expressing a heterologous gene comprising constructing an expression cassette comprising a promoter selected from the group comprising prZmHSP70 (SEQ ID NO: 1), prZmUbi158 (SEQ ID NO: 2), and prZmUbi361 (SEQ ID NO: 3), wherein the expression cassette is functional in a plant, plant cell, or plant tissue or portion thereof; and creating a plant, plant cell, or plant tissue or portion thereof comprising the expression cassette, wherein the heterologous gene is expressed. The invention further relates to expressing the heterologous gene in a plant, plant cell, or plant tissue or portion thereof wherein the plant, plant cell, or plant tissue or portion thereof is a monocot. The invention further relates to expressing the heterologous gene in a plant, plant cell, or plant tissue or portion thereof wherein the plant, plant cell, or plant tissue or portion thereof is maize. The invention further relates to expressing the heterologous gene in a plant, plant cell, or plant tissue or portion thereof wherein the plant, plant cell, or plant tissue or portion thereof is a dicot. The invention further relates to expressing the heterologous gene in a plant, plant cell, or plant tissue or portion thereof wherein the plant, plant cell, or plant tissue or portion thereof is selected from the group consisting of tobacco and soybean. In another aspect, the present invention also relates to progeny of the plant, plant cell, or plant tissue or portion thereof, comprising a promoter selected from the group comprising prZmHSP70 (SEQ ID NO: 1), prZmUbi158 (SEQ ID NO: 2), and prZmUbi361 (SEQ ID NO: 3). The present invention also relates to seed derived from the progeny of the plant, plant cell, or plant tissue or portion thereof. The present invention further relates to grain derived from seed derived from the progeny of the plant, plant cell, or plant tissue or portion thereof.

The present invention further relates to a nucleic acid sequence capable of driving expression in a plant cell, wherein the nucleic acid sequence comprises a nucleic acid sequence that is selected from the group consisting of (a) a nucleic acid sequence that is at least 80% identical to one of SEQ ID NOs: 1-3; (b) a nucleic acid sequence that is a functional fragment of one of SEQ ID NOs: 1-3; and (c) a nucleic acid sequence that hybridizes under stringent conditions to one of SEQ ID NOs: 1-3.

REFERENCES

Iyer M., Wu L., et al. V (2001) Two step transcriptional amplification as a method for imaging reporter gene expression using weak promoters PNAS 98(25):14595-14600.

Larkin, J. C., Oppenheimer, D. G., Pollock, S., and Marks, M. D. (1993) *Arabidopsis* GLABROUS1 gene requires downstream sequences for function. Plant Cell. 5(12): 1739-1748.

Sieburth, L. E., and Meyerowitz, E. M. (1997) Molecular dissection of the AGAMOUS control region shows that cis elements for spatial regulation are located intragenically. Plant Cell. 9(3): 355-365.

Batzer, et al (1991) Enhanced evolutionary PCR using oligonucleotides with inosine at the 3'-terminus. Nucleic Acid Res. 19:5081.

Ohtsuka, et al (1985) An alternative approach to deoxyoligonucleotides as hybridization probes by insertion of deoxyinosine at ambiguous codon positions. J. Biol. Chem. 260: 2605-2608.

Rossolini, et al (1994) Use of deoxyinosine-containing primers vs degenerate primers for polymerase chain reaction based on ambiguous sequence information. Mol. Cell Probes 8:91-98.

Paszkowski et al (1984). Direct Gene Transfer to Plants. EMBO J 3:2717-2722

Potrykus et al (1985) Molecular and general genetics of a hybrid foreign gene introduced into tobacco by direct gene transfer. Mol. Gen. Genet. 199:169-177

Reich et al (1986) Efficient transformation of alfalfa protoplasts by the intranuclear microinjection of Ti-plasmids. Bio/Technology 4:1001-1004

Klein et al (1987) High velocity microprojectiles for delivering nucleic acids into living cells. Nature 327:70-73.

Uknes et al (1993) Regulation of pathogenesis-related protein-1a gene expression in tobacco. Plant Cell 5:159-169

Hofgen, R, and Willmitzer, L (1988) Storage of competent cells for *Agrobacterium* transformation. Nucl. Acid Res. 16:9877

Schocher et al (1986) Co-transformation of foreign genes into plants. Bio/Technology 4:1093-1096

Gordon-Kamm et al (1990) Transformation of Maize Cells and Regeneration of Fertile Transgenic Plants. Plant Cell 2:603-618

Fromm et al (1990) Inheritance and expression of chimeric genes in the progeny of transgenic maize plants. Bio/Technology 8:833-839.

Koziel et al (1993) Field performance of elite transgenic maize plants expressing an insecticidal protein derived from *Bacillus thuringiensis*. Bio/Technology 11:194-200

Vasil et al (1992) Herbicide resistant fertile transgenic wheat plants obtained by microprojectile bombardment of regenerable embryogenic callus. Bio/Technology 10:667-674

Vasil et al (1993) Rapid production of transgenic plants by direct bombardment of cultured immature embryos. Bio/Technology 11:1553-1558

Weeks et al (1993) Rapid Production of Multiple Independent Lines of Fertile Transgenic Wheat (*Triticum aestivum*). Plant Physiol. 1102:1077-1084

Murashiga et al (1962) A revised medium for rapid growth and bio-essays with tobacco tissue cultures. Physiologia Plantarum 15:473-497

Negrotto et al (2000) The use of phosphomannose isomerase as a selectable marker to recover transgenic maize plants (*Zea mays* L.) via *Agrobacterium* transformation. Plant Cell Reports 19:798-803

Eastmond, P. J., van Dijken, A. J. H., Spielman, M., Kerr, A., Tissier, A. F., Dickinson, H. G., Jones, J. D. G., Smeekens, S. C., Graham, I. A. (2002). Trehalose-6-phosphate synthase 1, which catalyses the first step in trehalose synthesis, is essential for *Arabidopsis* embryo maturation. Plant J. 29, 225-235.

Nuccio, M. L., Russell, B. L., Nolte, K. D., Rathinasabapathi, B., Gage, D. A., Hanson, D. A. (1998). The endogenous choline supply limits glycine betaine synthesis in transgenic tobacco expressing choline monooxygenase. Plant J. 16, 487-496.

Ranocha, P., McNeil, S. D., Ziemak, M. J., Li, C., Tarczynski, M. C., and Hanson, A. D. (2001). The S-methylmethionine cycle in angiosperms: ubiquity, antiquity and activity. Plant J. 25, 575-584.

Ritchie, S. W., Hanway, J. J., Benson, G. O. (1997). How a Corn Plant Develops. Special Report No. 48. Iowa State University of Science and Technology Cooperative Extension Service. Ames, Iowa.

Rontein, D., Dieuaide-Noubhani, M., Dufourc, E. J., Raymond, P., Rolin, D. (2002b). The metabolic architecture of plant cells. Stability of central metabolism and flexibility of anabolic pathways during the growth cycle of tomato cells. J. Biol. Chem. 277, 42948-43960.

Vogel, G., Aeschbacher, R. A., Müller, J., Boller, T. and Wiemken, A. (1998). Trehalose-6-phosphate phosphatases from *Arabidopsis thaliana*: identification by functional complementation of the yeast tps2 mutant. Plant J. 13, 673-683.

Wingler, A. (2002). The function of trehalose biosynthesis in plants. Phytochem. 60, 437-440.

Armenta, R. T. Tarnowski, I. Gibbons, and E. F. Ullman (1985) Improved Sensitivity in Homogeneous Enzyme Immunoassays using a Fluorogenic Macromolecular Substrate: an Assay for Serum Ferritin, Analytical Biochemistry, 146:211-219.

Ebert P., Ha S., An, G., Identification of an essential upstream element in the nopaline synthase promoter by stable and transient assays. Proc. Natl. Acad. Sci. USA 84:5745-5749 (1987)

Lawton M., Tierney M, Nakamura I., Anderson E., Komeda Y., Dube P., Hoffman N., Fraley R., Beachy R., Expression of a soybean β-conclycinin gene under the control of the Cauliflower Mosaic Virus 35S and 19S promoters in transformed petunia tissues. Plant Mol. Biol. 9:315-324 (1987)

Odell J., Nagy F., Chua N., Identification of DNA sequences required for activity of the cauliflower mosaic virus 35S promoter. Nature 313:810-812 (1985)

Sanger M., Daubert S., Goodwort R., Characteristics of a strong promoter from figwort mosaic virus: comparison with the analogous 35S promoter from cauliflower mosaic virus and the regulated mannopine synthase promoter. Plant Mol. Biol. 14, 433-43 (1990)

Pellegrineschi A., Kis M., Dix I., Kavanagh T., Dix P., Expression of horseradish peroxidase in transgenic tobacco. Biochem. Soc. Trans. 23(2):247-250 (1995)

Walker J., Howard E., Dennis, E., Peacock W., DNA sequences required for anaerobic expression of the maize alcohol dehydrogenase 1 gene. Proc. Natl. Acad. Sci. USA 84:6624-6628 (1987)

Yang N., Russell D., Maize sucrose synthase-1 promoter directs phloem cell-specific expression of Gus gene in transgenic tobacco plants. Proc. Natl. Acad. Sci. USA 87:4144-8 (1990)

Chandler V., Radicella J., Robbins T., Chen J., Turks D., Two regulatory genes of the maize anthocyanin pathway are homologous: isolation of B utilizing R genomic sequences. Plant Cell 1:1175-1183 (1989)

Batzer M., Carlton J., Deininger P., Enhanced evolutionary PCR using oligonucleotides with inosine at the 3'-terminus. Nucleic Acid Res. 19:5081 (1991)

Ohtsuka E., Matsuki S., Ikehara M., Takahashi Y., Matsubara K., An alternative approach to deoxyoligonucleotides as hybridization probes by insertion of deoxyinosine at ambiguous codon positions. J. Biol. Chem. 260:2605-2608 (1985)

Rossolini G., Cresti S., Ingianni A., Cattani P., Riccio M., Satta G., Use of deoxyinosine-containing primers vs. degenerate primers for polymerase chain reaction based on ambiguous sequence information. Mol. Cell. Probes 8:91-98 (1994)

Ingelbrecht I., Herman L., Dekeyser R., Van Montagu M., Depicker A., Different 3' end regions strongly influence the level of gene expression in plant cells. Plant Cell 1:671-680 (1989)

Sambrook, J. et al., In Molecular Cloning: A Laboratory Manual; 2nd ed.; Cold Spring Harbor Laboratory Press Cold Spring Harbor, N.Y., 1989

Ausubel, F. M., Brent, R., Kingston, R. E., Moore, D. D., Seidman, J. G., Smith, J. A. and Struhl, K., Eds.; In Current Protocols in Molecular Biology; John Wiley and Sons: New York, 1990

Geiser M., Schweitzer S., Grimm C., The hypervariable region in the genes coding for entomopathogenic crystal proteins of *Bacillus thuringiensis*: nucleotide sequence of the kurhd1 gene of subsp. kurstaki HD1. (1986) Gene 48:109-118

Van Damme E., Smeets K., Van Leuven F., Peumans W., Molecular cloning of mannose-binding lectins from Clivia miniata. (1994) Plant Mol. Biol. 24:825-830

Castle L., Siehl D., Gorton R., Patten P., Chen Y., Bertain S., Cho H., Duck N., Wong J., Liu D., Lassner M. Discovery and directed evolution of a glyphosate tolerance gene. (2004) Science 304, 1151-1154

Cheng M., Janet R., Zhijian L., Xing A., Demski J., Production of fertile transgenic peanut (*Arachis hypogaea* L.) plants using *Agrobacterium tumefaciens*. Plant Cell Rep. 15:653-657 (1996)

Cheng M., Fry J., Pang S., Zhou H., Hironaka C., Duncan D., Conner T., Wan Y., Genetic Transformation of Wheat Mediated by *Agrobacterium tumefaciens*. Plant Cell Rep. 15:971-980 (1997)

McKently A., Moore G., Doostdar H., Neidz R., *Agrobacterium*-mediated transformation of peanut (*Arachis hypogaea* L.) embryo axes and the development of transgenic plants. Plant Cell Rep. 14:699-703 (1995)

Newell, C. A., Plant Transformation Technology. Mol. Biotechnol. 16:53-65 (2000)

Weissbach and Weissbach, Eds.; In Methods for Plant Molecular Biology; Academic Press, Inc.: San Diego, Calif., 1988

Maliga et al., In Methods in Plant Molecular Biology; Cold Spring Harbor Press, 1995

Birren et al., In Genome Analysis: Detecting Genes, 1; Cold Spring Harbor: New York, 1998

Birren et al., In Genome Analysis: Analyzing DNA, 2; Cold Spring Harbor: New York, 1998

Clark, Ed., In Plant Molecular Biology: A Laboratory Manual; Springer: New York, 1997

Jones J., Dunsmuir P., Bedbrook J., High level expression of introduced chimaeric genes in regenerated transformed plants. EMBO J. 4:2411-2418 (1985)

De Almeida E., Gossele V., Muller C., Dockx J., Reynaerts A., Botterman J., Krebbers E., Timko M., Transgenic expression of two marker genes under the control of an *Arabidopsis* rbcS promoter: Sequences encoding the Rubisco transit peptide increase expression levels. Mol. Gen. Genetics 218:78-86 (1989)

Komarnytsky, S., Boris, N., Functional analysis of promoter elements in plants. Genetic Engineering 25: 113-141 (2003)

SEQUENCE LISTING (61 sequences)

SEQ ID NO: 1 - DNA, 3005 bp, Zea mays
  promoter (1)..(3005)
aataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaaggcaatggaacaaggcgttagaagtttcatccaacttttttgctggtcttaattgcaacttctcctagaactctgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagaactcgtatggtgtttgatcgagtttcttcatcaatgtagaccttgtttagatactctcatatttacttcaatacatgtgtattgaggtgaactagagtgtaaattagtttaaattacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattctagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaagagatcgccggcaagggcgatcgcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatccggccaagaaccaggtcgccatcaaccccatcaacaccgtctttggtgagtacactccaccatttaggctcttactcctttcctagctcggatacgttttgtttaccgtgactagcggttttgtctgacccatacgacccatctacgttactgcttgatttgatatgtttaagtttctgtcgtaaaagtagctcagatccgatctagtttggctatgtttttgtctagatcggttggatctgaaggcgactgtgatctgtagtagttccgtagttatttttcctctggctgggtttagatctgttattgtttgtcatggtagctttagatctatttgttttttatcacctatttggtatataatactggtccgaaggctctgcagtactatttgtcaactcttggcagattgatgatgaaacaattaccccaagcgctttattccactgatgccagtgatggaaaactatgttatcatagtttttgtggttttcaatctgaaactgcagatcaagagtttttttaggtttccttcgattttgtgtttggtttttcttcttccagccatgacaaaatgaaaaccattagttttatttggttaagtaatgggataagtgatgatatttgtatccacacgagatatctgtatttactattatgccaacattatgcatctccatctgatctctcattatcttatcatattgctttagctacaactattggctccctagttttagattgtaccttatatgattggtggttggcacctctgcacatcaatcattgctttgattgccaacgtttaaaaatgttgtactgctatttatttgctcttattttttatcatgcatgtggttgagatttacttgagtagaacgttcacgttgtagtacaatttttactggagaagtgatgaagtcataacataggaaatatctgcattcactgtgatgatcacatcatgcactaccatctgatctcctacatttcaattttattgcaaacttttgccagttttatagtaacttgtaattcggcagtagttctgtgaagtctatagtatttgttgttttttatgtgcaatccgtgatgcaagacaatttcctgaaccactgtgattagtacagcaaaaatcaccatctttcgactgagattgcactgccagtttgagttttattgcatgcaaagtgtttctgtgtgtaatttgttgcagtcaatgccatttggtatctgactcgcagtcatttttcgtgattgtgtgtctcgaaacatggcagaaaacaaaggggaatggatcttgcgacactggttgaccatttatgagcttccagttactatatgcccatttacattatctgtttgggcaagtgattatgactgaaaaaactgacgtctgttttttcttagctagcaagttgtattttttttgaaatcagtctgattattggagtttgttgattgacctttatgctattggtatcttgactcatgtcagttttttattagttaggtatacttggttacataagcagatatcatttgattgatcaaagttttgtatttgttaacagaagtgttgttgtgttacatttcaaattgtatggtattagaatgcatttctgacatgattgggttcatatgcagatcccaagcg

SEQ ID NO: 2 - DNA, 4054 bp, Zea mays
  promoter (1)..(4054)
tggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtatttttacaacaattaccaacaacaacaaacaacaaacaacattacaattactatttacataaa

SEQ ID NO: 3 - DNA, 3087 bp, Zea mays
  promoter (1)..(3087)
gacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatccagagtatttttacaacaattaccaacaacaacaaacaacaaacaacattacaattactatttacataaa

SEQ ID NO: 4 - DNA, 15898 bp, Artificial Sequence
  Nucleotide sequence of the ZmHSP70 binary construct 15907
  promoter (820)..(3814)
  exon (3831)..(4445)
  Intron (4446)..(4854)
  exon (4855)..(6051)
  terminator (6058)..(7051)
attcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccagctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttcggtaccggaccgatccgaccaaataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaaggcaatggaacaaggcgttagaagtttcatccaacttttttgctggtcttaattgcaacttctcctagaactctgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagaactcgtatggtgtttgatcgagtttcttcatcaatgtagaccttgtttagatactctcatatttacttcaatacatgtgtattgaggtgaactagagtgtaaattagtttaaattacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattctagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaagagatcgccggcaagggcgatcgcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatccggccaagaaccaggtcgccatcaaccccatcaacaccgtctttggtgagtacactccaccatttaggctcttactcctttcctagctcggatacgttttgtttaccgtgactagcggttttgtctgacccatacgacccatctacgttactgcttgatttgatatgtttaagtttctgtcgtaaaagtagctcagatccgatctagtttggctatgtttttgtctagatcggttggatctgaaggcgactgtgatctgtagtagttccgtagttatttttcctctggctgggtttagatctgttattgtttgtcatggtagctttagatctatttgttttttatcacctatttggtatataatactggtccgaaggctctgcagtactatttgtcaactcttggcagattgatgatgaaacaattaccccaagcgctttattccactgatgccagtgatggaaaactatgttatcatagtttttgtggttttcaatctgaaactgcagatcaagagtttttttaggtttccttcgattttgtgtttggtttttcttcttccagccatgacaaaatgaaaaccattagttttatttggttaagtaatgggataagtgatgatatttgtatccacacgagatatctgtatttactattatgccaacattatgcatctccatctgatctctcattatcttatcatattgctttagctacaactattggctccctagttttagattgtaccttatatgattggtggttggcacctctgcacatcaatcattgctttgattgccaacgtttaaaaatgttgtactgctatttatttgctcttattttttatcatgcatgtggttgagatttacttgagtagaacgttcacgttgtagtacaatttttactggagaagtgatgaagtcataacataggaaatatctgcattcactgtgatgatcacatcatgcactaccatctgatctcctacatttcaattttattgcaaacttttgccagttttatagtaacttgtaattcggcagtagttctgtgaagtctatagtatttgttgttttttatgtgcaatccgtgatgcaagacaatttcctgaaccactgtgattagtacagcaaaaatcaccatctttcgactgagattgcactgccagtttgagttttattgcatgcaaagtgtttctgtgtgtaatttgttgcagtcaatgccatttggtatctgactcgcagtcatttttcgtgattgtgtgtctcgaaacatggcagaaaacaaaggggaatggatcttgcgacactggttgaccatttatgagcttccagttactatatgcccatttacattatctgtttgggcaagtgattatgactgaaaaaactgacgtctgttttttcttagctagcaagttgtattttttttgaaatcagtctgattattggagtttgttgattgacctttatgctattggtatcttgactcatgtcagttttttattagttaggtatacttggttacataagcagatatcatttgattgatcaaagttttgtatttgttaacagaagtgttgttgtgttacatttcaaattgtatggtattagaatgcatttctgacatgattgggttcatatgcagatcccaagcgtaaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgcggtttgttgtcagtcttgagtgtgctgcagttgctggctggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaccttttgccagttaggaggccattctcatttgattgtttaccacaatttttaggctgtcatgttatgtggcatttaatgaaattgataaactcccacccagaatagctagcagcttttgttgggtcctggtttttcttgtcctcgaagagttttgggagcaaaacggtttctttatatttttttttcctcaatacctcattatgtccgaaatctttctccgctagtatctgtactctgtgcagagatttttcttaaattctttatacctactaccttaataaaacactctcgtccataaatgttggtcatttttgttcttactatgttcttatgtcagaaatctttctcccccagtttttcaactctgtgcagagctttttcttaaattcattatacctactacctctataaaatactctcgtccataaatgttggccatttttatttttaaggagtcaaacatttttaactttgatataagaaattttaatatttatagtataaaatttatatcagatctttgaatctccttttataatgttacaataaaattattttataattttagttaaaattaagaaagtttaattgacacgaacaacatgtcgacaaacatttatcgatgaaggaagtaccatctctcttacattaccatttttaacaggacttataaaataccatctcttttacacgactaacatataaagcagggaccgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatctgctagccctgcaggaaatttaccggtgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 5 - DNA, 16941 bp, Artificial Sequence
  Nucleotide sequence of the ZmUbi158 binary construct 17239
  promoter (811)..(4866)
  exon (4867)..(5481)
  Intron (5482)..(5890)
  exon (5891)..(7087)
  terminator (7094)..(8093)
attcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccagctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttcggtaccggaccctggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattacggaccgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatctgctagccctgcaggaaatttaccggtgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 6 - DNA, 15975 bp, Artificial Sequence
  Nucleotide sequence of the ZmUbi361 binary construct 17282
  promoter (811)..(3899)
  exon (3900)..(4514)
  Intron (4515)..(4923)
  exon (4924)..(6120)
  terminator (6127)..(7127)
attcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccagctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttcggtaccggacccgacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatccagagtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccatcagtcgttgaagctgctgctgtatctgggttatctagtgtctctgccattgcccaaggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccatacggaccgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatctgctagccctgcaggaaatttaccggtgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 7 - DNA, 68 bp, Tobacco mosaic virus
  enhancer (1)..(68)
gtatttttacaacaattaccaacaacaacaaacaacaaacaacattacaattactatttacataaacc

SEQ ID NO: 8 - DNA, 11 bp, Zea mays
  enhancer (1)..(11)
ataaaccatgg

SEQ ID NO: 9 - DNA, 11 bp, Zea mays
  enhancer (1)..(11)
gtaaaccatgg

SEQ ID NO: 10 - DNA, 6232 bp, Artificial Sequence
  Nucleotide sequence of the ZmHSP70-GUS expression cassette
  promoter (1)..(2995)
  exon (3012)..(3626)
  Intron (3627)..(4035)
  exon (4036)..(5232)
  terminator (5239)..(6232)
aataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaaggcaatggaacaaggcgttagaagtttcatccaacttttttgctggtcttaattgcaacttctcctagaactctgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagaactcgtatggtgtttgatcgagtttcttcatcaatgtagaccttgtttagatactctcatatttacttcaatacatgtgtattgaggtgaactagagtgtaaattagtttaaattacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattctagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaagagatcgccggcaagggcgatcgcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatccggccaagaaccaggtcgccatcaaccccatcaacaccgtctttggtgagtacactccaccatttaggctcttactcctttcctagctcggatacgttttgtttaccgtgactagcggttttgtctgacccatacgacccatctacgttactgcttgatttgatatgtttaagtttctgtcgtaaaagtagctcagatccgatctagtttggctatgtttttgtctagatcggttggatctgaaggcgactgtgatctgtagtagttccgtagttatttttcctctggctgggtttagatctgttattgtttgtcatggtagctttagatctatttgttttttatcacctatttggtatataatactggtccgaaggctctgcagtactatttgtcaactcttggcagattgatgatgaaacaattaccccaagcgctttattccactgatgccagtgatggaaaactatgttatcatagtttttgtggttttcaatctgaaactgcagatcaagagtttttttaggtttccttcgattttgtgtttggtttttcttcttccagccatgacaaaatgaaaaccattagttttatttggttaagtaatgggataagtgatgatatttgtatccacacgagatatctgtatttactattatgccaacattatgcatctccatctgatctctcattatcttatcatattgctttagctacaactattggctccctagttttagattgtaccttatatgattggtggttggcacctctgcacatcaatcattgctttgattgccaacgtttaaaaatgttgtactgctatttatttgctcttattttttatcatgcatgtggttgagatttacttgagtagaacgttcacgttgtagtacaatttttactggagaagtgatgaagtcataacataggaaatatctgcattcactgtgatgatcacatcatgcactaccatctgatctcctacatttcaattttattgcaaacttttgccagttttatagtaacttgtaattcggcagtagttctgtgaagtctatagtatttgttgttttttatgtgcaatccgtgatgcaagacaatttcctgaaccactgtgattagtacagcaaaaatcaccatctttcgactgagattgcactgccagtttgagttttattgcatgcaaagtgtttctgtgtgtaatttgttgcagtcaatgccatttggtatctgactcgcagtcatttttcgtgattgtgtgtctcgaaacatggcagaaaacaaaggggaatggatcttgcgacactggttgaccatttatgagcttccagttactatatgcccatttacattatctgtttgggcaagtgattatgactgaaaaaactgacgtctgttttttcttagctagcaagttgtattttttttgaaatcagtctgattattggagtttgttgattgacctttatgctattggtatcttgactcatgtcagttttttattagttaggtatacttggttacataagcagatatcatttgattgatcaaagttttgtatttgttaacagaagtgttgttgtgttacatttcaaattgtatggtattagaatgcatttctgacatgattgggttcatatgcagatcccaagcgtaaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgcggtttgttgtcagtcttgagtgtgctgcagttgctggctggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaccttttgccagttaggaggccattctcatttgattgtttaccacaatttttaggctgtcatgttatgtggcatttaatgaaattgataaactcccacccagaatagctagcagcttttgttgggtcctggtttttcttgtcctcgaagagttttgggagcaaaacggtttctttatatttttttttcctcaatacctcattatgtccgaaatctttctccgctagtatctgtactctgtgcagagatttttcttaaattctttatacctactaccttaataaaacactctcgtccataaatgttggtcatttttgttcttactatgttcttatgtcagaaatctttctcccccagtttttcaactctgtgcagagctttttcttaaattcattatacctactacctctataaaatactctcgtccataaatgttggccatttttatttttaaggagtcaaacatttttaactttgatataagaaattttaatatttatagtataaaatttatatcagatctttgaatctccttttataatgttacaataaaattattttataattttagttaaaattaagaaagtttaattgacacgaacaacatgtcgacaaacatttatcgatgaaggaagtaccatctctcttacattaccatttttaacaggacttataaaataccatctcttttacacgactaacatataaagcag

SEQ ID NO: 11 - DNA, 7283 bp, Artificial Sequence
  Nucleotide sequence of the ZmUbi158-GUS expression cassette
  promoter (1)..(4056)
  exon (4057)..(4671)
  Intron (4672)..(5080)
  exon (5081)..(6277)
  terminator (6284)..(7283)
tggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaatta

SEQ ID NO: 12 - DNA, 6317 bp, Artificial Sequence
  Nucleotide sequence of the ZmUbi361-GUS expression cassette
  promoter (1)..(3089)
  exon (3090)..(3704)
  Intron (3705)..(4113)
  exon (4114)..(5310)
  terminator (5317)..(6317)
gacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatccagagtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccatcagtcgttgaagctgctgctgtatctgggttatctagtgtctctgccattgcccaaggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccata

SEQ ID NO: 13 - DNA, 266 bp, Zea mays
  misc_binding (1)..(266)
gtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcag

SEQ ID NO: 14 - DNA, 72 bp, Zea mays
  misc_binding (1)..(72)
ttttttggacctcgtgatagtcggtcggttcaatgttatcgcggctactggcaaaccttaagtgatacggta

SEQ ID NO: 15 - DNA, 419 bp, Zea mays
  misc_binding (1)..(419)
tcgtccgcttgcgaggtggtatgcagatctttgtgaagaccttgactggcaagaccataaccctggaggttgagagctccgacaccatcgacaacgtgaaggcgaagatccaggacaaagagggcatccctccagaccagcagcgtctgatctttgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtg

SEQ ID NO: 16 - DNA, 146 bp, Zea mays
  misc_binding (1)..(146)
gtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatcatgaat

SEQ ID NO: 17 - DNA, 627 bp, Zea mays
  gene (1)..(627)
ggcggggaggatttcgacaaccggctcgtgaaccacttcgtccaggagttcaagaggaagaacaagaaggatatcactggcaaccccagggcgctccggcgactgaggaccgcctgcgagagggctaagaggacgctctcctccaccgcccaaaccaccatcgagatcgactcgctctatgagggcatcgacttctacacgaccatcacccgtgctcggttcgaggagctcaacatggacctcttcgatcagtgcatggaacccgtggagaagtgcctccgcgacgccaagatggacaagagcagcgtgcacgacgtcgttctcgtgggcggttccactcgcatcccccgcgtgcagcagctgctccaggacttcttcaacggcaaggagctgtgcaagagcatcaacccagacgaggctgtcgcgtacggcgcggccgtccaggccatcctcactggcgagggcaacgagaaggttcaggatctgctcctgctcgacgtctcaccgctctcgctcggcctggagacggccggaggcgtcatgactgtgctcatccccaggaacaccaccattccgacaaagaaggagcaggtcttctccacttactccgacaaccaaccaggagtg

SEQ ID NO: 18 - DNA, 2494 bp, Zea mays
  gene (1)..(2494)
gcacgaggcctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaggctaccagtgtcggtgagaagaatgtcctcatctttgatcttggaggtggtacctttgatgtctccctcctcaccattgaggaaggaatctttgaggtcaaggccacagctggtgacacccatcttggtggtgaggactttgacaacaggatggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagtccgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagtgtgctgcagttgctggctggcccagttgctgccgcgagttatcgtcgtcagtcggtgcggtgtgtccgcttaaactttatttgtggtgggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaacttttgccagttaggaggccattctcatttgattgtttaccccaatttttaggctgtcatgttatgtggcatttaatgaaattcataaactcccccccagaatagctagcagcttttgttgggtcctggtttttcttgtcctcgaagagttttgggagcaaaacggtttttttat

SEQ ID NO: 19 - DNA, 1185 bp, Zea mays
  gene (1)..(1185)
atccgaccaaataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaacgcaatggaacaaggcgttagaagtttcatccaacttttttgctggtcttaattgcaacttctcctagagcactgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagagctcgtatggtgtttgatcgagtttcttcatcaatgtagaccttgtttagatactctcatatttacttcaatacatgtgtattgaggtgaactagagtgtaaattagtttaagttacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattccagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaa

SEQ ID NO: 20 - DNA, 910 bp, Zea mays
  gene (1)..(910)
ctcttgtgtacgtcgtgccgagatcgatgccgatagtcgggccatcgcccttgccggccatctcttcttctcactcagcggttgcggagcacgggaagggattggcggcggctgagaatggagcaggggactagggtttcgagagggcgagagactgagccgggcagtggcttttatagggaacaaagggctcgtcgtcagcgcgtgggctgtggtgttctagaatgttcctgggcgcgtcgtggggacatctgagccgttggcacgcgatcgtgtgaacgaaggcgcatggcggcgtcttttccacgggcgcctttcggctatttaaacggccttttttttcctttctggttgctttcacgtgagtaaaaggaatctttgacggagggatgggttgtgaccagatctcagcccaagtcatataccataaagtgctggccgggcccgcttacgcttagaaccagcccacagagacaagcctccctgatgagtcatttgtttcgatactcaatattcaccccaatccacgtgtaataaagtggattaaagtgtaatttaaactaatttacactctagttcacctcaatacacatgtattgaaagtaaatttgagagatcttaacaaggtctacatttgattgaagaaactcgatcaaacacctttcgaagctcttacaatccccttgctcccaataagcctcttcgagaaaactttaatctccttttgatatatatggggggatttgagtttctaaaacaaccccctccaaaaatatttgggatttttttttttccacactcccttttgggaaataaaaacaaaagggggttctttttttttttgatattttaacaaaataactttgtgtggggtcataaaaatattagggggggggggtgtttgtcttct

SEQ ID NO: 21 - DNA, 3085 bp, Zea mays
  gene (1)..(3085)
cgtatcacttaaggtttgccagtagccgcgataacattgaaccgaccgactatcacgaggtccaaaaaaataaccaccacaaaagtaccaaccaaccacaaataaagtttaagcggacacaccgcaccaactgacgataactctcggcagcaactgggccagccagcaactgcagcacactcaagactgacaacaaaccgcttagtccacctcctcgatcttggggccagggccgccgctgccggcaggggcgtcctcgtccatgccgccagcgccgcccatgtcttcacccgcgccctggtacatcttggcgatgatggggttgcagaggctctccagctccttcatcttgtcctcgaactcgtccgcctcggcgagctggttggcgtccagccagctgatggccgcgtcgatggcgtcctcgatcttcttcttgtcatcggccggcagcttggacgcaatcttctcgtccttgatcgtgttgcgcatgttgtaggagtagttctccagcgagttcttggcctccaccttcttcttgtgctcctcatcctcagacttgtacttctcagcgtcctgaaccatcttctcgatctcctccttggagagacggcccttgtcgttggtgattgtgatcttgttcttctgccccgttgtcttgtcctcggcagacacgttcaggatgccgttggcgtcgatgtcaaagcacacggtgatctgtggcacaccacggggtgcaggggggatgccggagagctcgaacttgcccagcaggttgttgtcgcgtgtccgggtcctctcaccctcgtagacctggatcaggacaccgggctggttgtccgagtaggtggagaatacctgctccttcttggtggggatggtggtgttcctcgggatcagcactgtcataactcctccagcagtctccagacccagggacagaggggtgacgtccagcagaagcaggtcctgcaccttctcattgccctcaccgctcaggatggcagcctggacagcagcaccataggcgacagcctcatcggggttgatgttcttgcacagctccttgccgttgaagaagtcctggagcagttgctgcaccctggggatcctagtggagccaccaacaagtacaacgtcatggacggtgctcttgtccatcttggcatccctcaggcacttctcaacaggctccatgcacttcctgaacaggtccatgttgagctcctcaaacctggcacgggtgatggtggagtagaagtcgatgccctcatacagcgagtcaatctcaatcgtggtctgggcagtggaagacagagtcctcttcgccctctcacaagcggtcctcagcctccggagagccctggggttgccagtgatatccttcttgttcttcctcttgaactcctggacgaagtggttgaccatcctgttgtcaaagtcctcaccaccaagatgggtgtcaccagctgtggccttgacctcaaagattccttcctcaatggtgaggagggagacatcaaaggtaccacctccaagatcaaagatgaggacattcttctcaccgacactggtagccttcttgtcaagaccataggcgatagctgcagctgttggctcgttgatgatacgcagcacattaaggccagcaatcaccccagcatcctttgtggcctgcctctgtgagtcattgaagtaggcagggactgtgaccacagcattcttgatcgtgctaccaaggtaagcttcagcaatctcacgcatcttgataagaaccatagaggagatctcttcagctgcaaactgcttctcctcacccttgtgctggacaacaatcattggcttctcaccaggcccagaaatgaccttgaagggccacaacttgatatcactctggacagacgcatcactgaacctcctgccgatgagacgcttggcatctgcatatgaacccaatcatgtcagaaatgcattctaataccatacaatttgaaatgtaacacaacaacacttctgttaacaaatacaaaactttgatcaatcaaatgatatttgcttatgtaaccaagtatacctaactaataaaaaactgacatgagtcaagataccaatagcataaaggtcaatcaacaaactccaataatcagactgatttcaaaaaaaatacaacttgctagctaagaaaaaacagacgtcagttttttcagtcataatcacttgcccaaacagataatgtaaacgggcatatagtaactggaagctcataaatggtcaaccagtgtcgcaagatccattcccctttgttttctgccatgtttcgagacacacaatcacgaaaaatgactgcgagttagataccaaatggcattgactgcaacaaattacacacagaaacactttgcatgcaataaaactcaaactggcagtgcaatctcagtcgaaagatggtgatttttgctgtactaatcacagtggttcaggaaattgtcttgcatcacggattgcacataaaaaacaacaaatactatagacttcacagaactactgccgaattacaagttactataaaactggcaaaagtttgcaataaaattgaaatgtaggagatcagatggtagtgcatgatgtgatcatcacagtgaatgcagatatttcctatgttatgacttcatcacttctccagtaaaaattgtactacaacgtgaacgttctactcaagtaaatctcaaccacatgcatgataaaaaaataagagcaaataaatagcagtacaacatttttaaacgttggcaatcaaagcaatgattgatgtgcagaggtgccaaccaccaatcatataaggtacaatctaaaactagggagccaatagttgtagctaaagcaatatgataagataatgagagatcagatggagatgcataatgttggcatcatagtaaatacagatatctcgtgtggatacaaatatcatcacttatcccattacttaaccaaataaaactaatggttttcattttgtcatggctggaagaagaaaaaccaaacacaaaatcgaaggaaacctaaaaaaactcttgatctgcagttt

SEQ ID NO: 22 - DNA, 400 bp, Zea mays
  gene (1)..(400)
agctttgcaacagcatcaaccccgatgaagctgttgcctacggagctactatccaggctgctatcatgagcggagaggatgactatgagaatgagatccagaattatctcctgttggatgctacccctctttctcttggtttggagacggatgggggcctcatgaccgtgatgattccaaggaacactaccattccaaccaaaaaggagatggtcttatcgactgactccgacaaccagccttgtatccgaatccgagtgtacgagggtgaggggtctattactcgtgacaaccacctgttgggtgagtttgagttttccgttattcctgcacctaggggtgttcctcagatcactgtttgcttcagtgtcgactggaatggtatcctgaatgtctccgc

SEQ ID NO: 23 - DNA, 1381 bp, Zea mays
  gene (1)..(1381)
ccccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggaggggattcctccggaccagcagcgcctgatctttgctggcaagcagctcgaggacgggcgcacgctggccgactacaacattcagaaggagagcaccctccacttggtgttgcgtctcaggggcggcatgcagatcttcgtgaagactctgactggcaagactatcacccttgaggtcgagtcttctgataccattgacaatgtcaaggccaagatccaggacaaggagggcatccctccggaccagcagcggctcatttttgccggcaagcagctcgaggacgggcgcacgcttgccgactacaacattcagaaggagagcaccctccacttggtgctgcgtctcaggggtggcatgcagatcttcgtgaagacacttactggcaagacgatcacccttgaggtggagtcctcggacaccatcgacaatgtcaaggccaagatccaggacaaggagggcattccaccggaccagcagcgcctgatctttgctggcaagcagctggaggatggccgtaccctcgccgactacaacatccagaaggagagcaccctccacctggtcgtccgcttgcgaggtggtatgcagatctttgtgaagaccttgactggcaagaccataaccctggaggttgagagctccgacaccatcgacaacgtgaaggcgaagatccaggacaaagagggcatccctccagaccagcagcgtctgatctttgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatgcttgaatccttatg

SEQ ID NO: 24 - DNA, 188137 bp, Zea mays
  gene (1)..(188137)
  misc_feature (2340)..(2439): n is a, c, g, or t
  misc_feature (4814)..(4913): n is a, c, g, or t
  misc_feature (7505)..(7604): n is a, c, g, or t
  misc_feature (14070)..(14169): n is a, c, g, or t
  misc_feature (20207)..(20306): n is a, c, g, or t
  misc_feature (28613)..(28712): n is a, c, g, or t
  misc_feature (42568)..(42667): n is a, c, g, or t
  misc_feature (53679)..(53778): n is a, c, g, or t
  misc_feature (70025)..(70124): n is a, c, g, or t
  misc_feature (88475)..(88574): n is a, c, g, or t
  misc_feature (108357)..(108456): n is a, c, g, or t
  misc_feature (129454)..(129553): n is a, c, g, or t
ggattgcgcgagtatctgtcgagacgagcttctccatgacgcccggaggatgttaatttagaacactgaccgctgtactcatatcggcacgatgacgtagtagccagcttgatttgtctaaagaagcgctttactaacccaaagaatcggtaaatcatttaaagccgctcttcgtgcgcggccacattgatgggataccgattgctaagatgttggtagatggaggggcggctgtaaatctgatgccttattcattatacagaaaattaggtaaacaagatgacgaacttgtcaagaccaacatgaccctcagcggtgttggaactgatagttcgatcaaagccaggggagtcacgtccgttgaattaaccatcgggactaagacccttgctgctgcattcttcgtcgctgatgtagaaggaaattacagtttaatcctaggcagagaatggattcacgccaatcaatgtataccttctacattacatcaaatgctgatacaatgggtaggcgatgacatagaacaagtacatgctgatgtatcggcctgcatcgctgtggccgatgcccctgtactctggacttatgagactgctacatgtctcacaggagtagacttttctgattatcaattcataagtatagataagaaaggtttcattcctgtaatgctagagccgatggagaatcggctaaatcctaaataaagttaaaatgatgaatacacacaaagttcatgagtctttggtcacagacagttcggccgccaaggccggatggtctggtctttcacaaaagagttcggactttaagaccgagcatctaccacagcgaaaagacagtattacggatgatccggtccccgagaccggaaattccgccatcacacaaagatcatctgattcctctgtgggggacatgatagaggaattcagagatcttgataaactaggacaggggtttacatcggccgatcctttggaggagattgacataggagatggtagaattccaaggccgacttttgtaaacaagaccctggagaccgattctagaaatgagatgatcggtctattgaaagaatattcagattgctttgcttggaattatactgagatgcctggattaagccgagagatcgtagagcatcggttgcctattaaatctggtttcagacctttcaagcaaagagctagaacatttcgtccagatcttctcccacgcatcaaggacgaaatccaccggctgctagaagctgattttatcagaccttgcagatacgcagagtgggtctccaatattgtgccggtggagaagaaggagacaggtaaacttagagtatgcattgattttcgcaatttaaatagagcaactcctaaagacgaatatcctatgcccatagccgacacattaattaataatgcatgaagaaataaaattattagcttccttgatggtaatgccggatataatcagattttcatggccgaagaagatacgtctaaaacggcctttatatgtccaggcttcattggtttatttgagtgggttgtcatgacatttggtctgaaaaatgctggtgctacttatcagagggctatgaatttgatcttccatgaattgttaggaaacactgtggaagtttacattgatgatattgtagtcaaatcggctgagtttagttctcatatagctgatttgcgtaaagcctttgataaaatgcgtcagtatggtttgaaaatgaacccacgtaaatgtgcttttggagtgtcggctggtaagtttttaggatttgtcatacatgaacatggtatagaaatagaccctgaccgaatcaagtctattcggaatgtgggacctccgacctgtaaggtcgaggtacagaggtttctcggcaaagtgaattatttacgaaggtttatttctaatctagccgggaagattgatgcgttcacccctattcttcggcttaagaatgatgccgaattcgcttggggggcagaacagcaagaagcatttgatctcatcaaaaaatacttatcttcggctcccgtattaaaagcaccacgagcaggagtaccattccgattatacattgcagctgaggacaaggtcattggggctgttctgacacaagaaaccgaggggaaggagcatgtggtgacatatctaagccgaaggttggtggatgctgaaacaaggtacacttttattgaaaagttatgcttatgcttgttttttgcatgcaccaaatgtagatgttattttctgtctagtcattgtactgtttctggtcaagccgatgtgatcaaatacatgacgaatctctagattcgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgaactgcccgcaagttacagaattgattctagcctacccacaggagcaaacgtcacctcaaagatgttaccaagaagtgtgtagttaatcatttgccacaagtcgagctttgtttgtcgtcgccaccgaatgtttttcctgtttgttgccgaaaaccctatttgtttccacagacgttatgcttaggaatgaggcaccacgttcaaacttcctttgcgcttgaaggttgttgagtacctcctgcatggattacacccagtccggatctagccaggcctcttctaccctgaaaggctcaatagaggagagaaaagagtaatgctcacaaaaattaactaatcgagatcgagtagttactcccttgctaatatcacccagaaattggtcgacgggatgatccctttgaatcatcgctcgaacttgggttggaggtgccgggtgtgcttcttcctccatcacatgatcatcttgtgctcccccttgatcacactcctcttgatgaacctgtccatcgtttttgagttggggaatgcaccattgttgagtaaagaaggatgatcttgctccagttgttcctgcgatcgcacatcacttaccgccatggtgcgcatagaggccgtgggaacgtcttcttcatctacatcatcaagatcaacaactcgctctcttggagagccattagtctcatcaaatacaacgtcgctagagacttcaacccaaacccaatgttttgttgaagactctatatgcctttgtatttgagtcataacctaataaaaacccttctacagctttgggagcaaacttagaatttctacccttctttactagaatgtagcacttgctcccaaatacacgaaagtaagatacattgggtttgctaccggttagtagctcatacgaagtcttcttgaggaggcgatgaaggtagaccctgttgatggcgtggcaagccgtgttcacggcttccgaccagaaacactcgggggtcttgaattctccaagcatcgtcctcgccatatcgattagcgtcctgttcttcctctctaccacaccattttgctgtggtgtgtagggagcggagaactcgtgcttgatcccttcctcctcaaggaactcctccacttgaaggttcttgaactcggatccgttgtcgctccttatcttcttcaccttgagctcaaactcattttgagctctcctgaggaagcgcttgagggtcccttgggtttcagacttatcctgcaaaaagaacacccaagtgaagcgggaaaagtcatcaacgataactagaccatacttacttcctcctatgctcagataggcgacgggtccgaagaggtccatatgtagcagctccaggggtcttgatgttgtcatcacatttttggtgtgatgagagcctcccacctgtttccctgcttgacaagctgcacaaggtctatctttttcgaaatgaacattggttagacctatcacgtgttctccctttagaagcttgtggaggttcttcatccccacatgtgctaagcggcgatgccacagccagcccatgcaagtcttagccattaagcatgcatctagaccggcctcttcttttgcaaaatcaactaagtaaagcttgccgtctagaatacccttaaaagctagtgaaccatcacatcttctaaagacagacacatctatatttgtaaacaaacagttatatcccatattgcataattgactaacagatagcaaattatatccaagagactctactaaaaacacattagagatagagtgctcatttgagattgcaattttacctaacccttttaccttgccttgattcccatcaccgaatattattgaatcttgggaatccttattcttgacgtaggaggtgaacatcttcttctcccccgtcatatggtttgtgcatccgctgtcgataatctagcttgaacccccggatgcataaacctgcaaggcaaatttaggcttgggacttaggtacccaactcttgttgggtcctacaaggttagtcacaatttccttagggatccaaatgcaagttttatcacccttgcattttgcccgtaacttcctagcaatcacctttctatcctttctacaaattgcaaaggaagcattcaaagcatgatatattgtagaaggttcattaactttcctaggaacattaacaacatttctcctaggcatattatgaacaacatttctcctaccaacattcctatcatgcacatagaaagaactagaagcaaacatgtcatgagaatcataaacatttttttcgaaaacattataacttctatttgcatttctagtatgtctcctatcatgtcgaatctctagtaactttcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataaaaagaaacggagggagtataatagaaggcacaaaatgcaatattttgctctaactccattttttataagtgaaagagaaatagacctggagtcatttctatattggttttgctgtttgatgaccatcacaacttattgaactggctaatttgataaatgtttgatcacgtgataaaaaaaattgaatttagaagattatatgtagagatatagcttagacttagaggaaaaaatgacatatggagtagaaaatggactttgtgttattttaacatttggataagttctaaaatgttctaacaacattctagaacatagttggcaatatcagatttagtatttggagttccagatgtcaattgtcgcaaagtcttagaaatattgagcaaagtgatttagaagatcagctgaggcaagatgtgtgacttaaagtgtttagatagactcaagatatatttgtataaatcataaaaatgctcagggcaccgacaaaaagaaacaaaaaagttacgcctagtttagataaagttgttgttagtgcaatggacacatgcccggtgtacaccaaacacgttttcagacacgacaatgagagagcatgtttttagttatgtggagtttgacacactggacttgtccgatgtgccatcggacaactatccagattcagcacacatagagcatgtaaaatagctttggcaactgtgccacctgataaacagtacacccaaccatcgaaagtgaagatccaacagtcggttgatgtggcgtgtccgatatgcacacttttcagacggctaccattgaacaacctgcttttcttatctctccatttctgtttcttctatgtggacacaaatatgacgtggtgtctcttgtagcacgcctactatacgtggctaatggactgtatcgagacagcacgacctaaacccgtcacgagccgatccgatatagcggggccaaggcacgacagaaataaatagtgggtcgtgccatgtcagactgtgtgctgaagtttgagcctaaacacgactcatctggttttaaacggatcgtgtcggactataatgtcgtgtcgtgctatcgcatcccgtcttataatagagctcgaaaataatttattttttctctattatttatagctcgttttcctcgttttttgtatcacgtctaaaaatggggttagatcgatcatcgatgtatatatatgaattagattggaaccaaagttcgagtcataaacaggccgtgtcaggccatgttcgtcctgatgagctatctgtgctcggcatgggatgagacaacgataaatgagtcgtgcccatattaactgatgggcttgtccgcaagttcaagcacgatctacaatggacggaccttgatccgacccgaacacagttactgttgtaccgtgcagtgccaaaatgtccggctggctcatatggtacgttactttgctcgacaaaacaaaataagtgtctttagaaaaagagagagcaaaagtcccttgtgctgcgacggcttggcaaacatgcacgatgcaggctgcacgcagcatgccaccggcccaccgccctggttccttggaaacagagtgagcgcctcctgtccggtccaaaaccggcgacgcgctccctgttttccactggaacccgccaccgtttctccgccgggttccgcgtataaaaaacggccaagctcactgccacccctcgcctcgctcccgtcgcttgacctgtactgtccccacggagatcacgacacgaaccgagcaagaaccgcacgagccgagcccagcagcaggatggcggcggcggcgagcgggaaggcgccgtcgctggtggtggcggcgagcatgggcgcggtggaggcgctcaaggaccaggcgggcctgtgccgctgggactacgcgctgcgctcgctctaccaccgcgccgccgccgcgccccggatccgcgcgctgtccgccgcgctctcggactccgtgtccgtgccggcggacgcgcccccgcgggcgtcgcggccaccgcccccgccggcgccgcgggacgcggacaggatgcgcaaggcctaccacctcgtgtgctggggccccaactgatcggcggccggcgggcgggcgggcgggcgccgactgcatgcctgtagctgtagcgcgcgcgctgaccaaggcctggctgggtgtggttgtctacttgtctgtagcttcttcttcttgttgttggctcctctcgtgtgtgtgtgtgttgctctcgctccgtccatcgattccatccgtgtccgtcggcagatgagatgagaatgagaaggcgatgtgaatgctcttccgtcgtttgggttccggagccgaggattccctaaacaaaaccaattttactacgtgcgctgcgtacaattccgtcgtttgggagctggcatgtccttgcgttgcgcgcacgagcgtcgccgacgcccgacggttaggcgcgctggctggaactggaaggaaggtggatatggctttgatgactgattgcctatactgatgactcgtcggccagccggagaaagcagaggaacgaatcaagctgattctcagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcaaatgatgcgtgcccttgcctctcttctcttggtctggactgagctggagtggatcagccaggtgtccgaggacagcaggtgtgtcctgtagctgtgtagcaccgtccactgggctccagcctctatccagcactggcgtcgtcgccgctggtttgagctctggatcctcgccgatctgtcgagcagagaccagagatactacaaactgtaaccgcaagaaatgactctaaagatgatgggtttgatattccttggtgaagctacataaagcatgcaagggattgatatatcacgaagagaacaggtacagatagatcacgaagcagtggctgtggcaaccccacgttccagtcaatcctacatgcgcacagcagttccctgctgaccattcatagcgattgacgatggcatgctaatccttttgttgtaaagaaaaaaatttgaagaagaaatgtgtcgtgtagatttaggtggtgtttggttttctagagactattattttagtccattcgttttattttattttgttccttaaattatcaaattttaaaattagatatatgatttagttttgacaatttataaattaaaatataataaaataaaatgactaaaattaatctatagaaaccaaacaccaccttacatatgtatcatgactcacatggacacacaccacccacccgcctacaataaagcatgcatacacatatcactacacctttaaaatgtgagttccgtcgtgcgtcgtctcctctagttttgcgagcagagttaaaattcccctttcacacgaaatgtcaaaaaaatatggtgtggaggtttcaaaccgacaaaccctgctcgcttaatataaaggaaagatattgtaataatatacatgtactaataatttgaaaataaaaaaaatataatcatctttgaataaacattcatttaagcagcgtataatatatatggaaactgtagtagtttatgaacaactaatggtgtggaggtttcaaaccgacaaaccctcctcgcttgatataaaggaaagatattgtaataatatacatatatcaataatttgaaaataaaaatataatcatgtttgaataaacatctcatgtaagcaatgtatagatatataatatatacgaaaaccgtagtagtttatgagcaactaactatcttgattggtattcgtagctttgtgatatggttacgccatacttcgcaatcagctgatcttaaaacacctactagttaggtgctcgtgcgctactacggtttttatatatattggtcgatagggggaagatcgcccacacagtattatattaagaaaaacttattcgaagccccgacagagaaaaggcacgaaagttgctcctgatgcaacatgagggttcggtccctatataataaattaaaatatatgatttagttttggcaatttataaattaaaatataataaaatagaatgactaaaattagtccatataaaccaaaaatcaccttacatatgtgtcatgactcacatcgacacacaccatccacccgcctacaatgagcatgcatacacatatcactacacctttaaaatgtgagttcggtcgtccgtcgtctcctccaactttgcgagcgagttaaaattcccctttcacacgaaatattcaaaaaaaatatggtgtggaggtttcaaactgacaaaccctgctcgcttgatataaagtactcagcttctatcgcttcaacttttatctggttgtattatataaaggaaatatattgtaataatatatatactaataaatttaaaacaaagaatataatcatatttgaataaatatctcatttaagcaatatctacatatataatatatagaaaccgtagtagtttatgagcaactaactatcttgattgatattcatatctttgtgatatggttacgccatacttactatggtttctatatatctcggtcggtaggggaaagaccaccccaatggtattatattaagaaaaaactaattcaaaaccccgaccgagaaaagtcacgcccgcataagtctgtccatttcgcgtgcacacgaccaagagaaccaacgagcgatttgttttgcaatcataattttgaaatccgctttcactgggtttcgaactcaggacttgagcagtgctagccataccacctaaccaacttggctagagtttttttcacgatttctacatatcatagaaaaaattctgtttaaatgagataattattcaaacacatccaaatatttacaataatttgtgctctatttgaactggtcgttgtgcccgatctcaacacgtcaaccacataacatgcataaatctatactacttattaagaaggtaagagtagtctgtcgttctgcccttccccgtgttctgtcgttctgctctctcccgctcagggatcgaaccttagatctattgagtagaatgtctagccttccaccctctagccaacatgactcatattgaattgtgtacaacttcaactaagattttatttgtatttaacccgccgcccactctgtatgctcactgagtttagaaaaacatttatagcttggcccctgatctttctggaatttgggacgcagtccaggaaataaagaaaatagggaaaatgagcttagaaattgatttttagtttaaaaataattgcagaaacccatttaattcatggaaatttcatattaaatccaaatgagttcattccaatttctataattctataatattattttttatcacataatacatctgttttgtcatgaaaacaacaataaaattgatttcctaattaatcctatatcaaatacatagaaactttggaaattcgtaacttccccattttaattctaaattgaaccgttccagttgtgtcagtctcgtatgaatatttactacgcagtaacaacattgattataccatgttttatacttttataattagatatttatttatcctatgttaattgagttaatctatgtctattggattaatttatttaatatattaatatagtattctaactttatggttatacgatgtttgaccattagtcttgcaaacacacacacttacctttttgtttaagcaaaagcgtatggtggtacgtgtccgatgactaacgatgtacgagggaatttcttccggtatgtgtgaaacgtgctctccaataatgagaccatgcaaatcttgacatatatcgaagtatgcatgatactgatggttgcaatgtagtggtgaaacagatagattataaataacaaaaattatgtatggccagaatcacaaattaattatgaaacattttctcataacggtataacacatattttgtatataagttatcgtaatatactggtattatatattcccgttgcaacgcagggcattcagctatatatatatatatatatatatatatatatatatatatatatatatatattcatttgatgaatgaattgtatctccatcaactatatgttaagaaaacatctattagagacatcatatccaccacatcttattttgatgttatagtagaagatatgagagttattaaaagtaagatatggcctggctgatgccacactaagccataatggctcctccaccactgttatccggcaaaccatcacattctgtgacgcgggacgtcgagcaactcctgacttggggcactccggtcccatatgacaaaatcccccattcccattcaaccattcctatcgtgcaagccatcacacactccggacgttgggcccacattgcagactacggacgcccacatgacagccaccattagttttgcacacaccgaacccacgtctgctcgcgcaaaaagttgcctcaatttgacactagcaggagcatttgaccatgattgctttctctaaagaaggaaggcttataatccggtagaagctatgttggctggccggtatggtcataaaaatgtgcaatccgtgatgacgacataggtcgcgtgggctgtgtttctttggtgcggcccaagtagctaccaggaggtcgcacgcttcttaccctgacccagcttggctttagggtcagtctcccttgctttctctgcccagcgagccctcgccctctagctcttcctactagcgccgtctccgtcccgtgctctcctgttcatcgtcgatctcagccatctcaggagcacccgctcactcccagacgcccgcacaaatgaatcccccacaatctccctccaaactgcccactccctccacgatctccccctctagctcatgatccctctgcccgccccccaccccccgcctgccacgcccacaggcgcaacaagccaacaacccacactcggccccgctaccccgatccgtcgccataaatcccgctacctcctcctcgagtcctgcttgatcgccccatgctcgaccggtcgaccgtacggaagggcagccccgaccgtgaccacagcgcgatgtgcgacgagtgagggcagtggcgggggttgcgaccaacgacggagagccacacaaagaagctcgtcggcgatgttttcctcaaggttcgctcgctcattccttccttccttgtgctattggcgtgtgatcctagctagcgctctcttgatttcatccttatccacgtgaatcctggatcacactgcatgcagatcagattactggaaggccagaccagctgctcgcattcactggtgcatggtgtgggagctgagagccccgttcctatggtcgggccccacctctcttgggcccttgtgcagatacgcagaggtagtgtcccctaatttatttgtcatgtcccctaatttgtttgtcagagctacttgaggatgtcaatgaggtatggctccgctggttcatcagtattcagtaattacaaggcattatgagttagcatgctccctcctgctaagctagctaaatatggttatcaagtctcaataagtatccatttttaaaagtataaattgttatatccatacatgcgagtctttattttggaaataaccaaaggttctgaacctgcattgtgctaactcgtcaatcattcctgaaatgcgattctttttttttcattcagagttcggttggacaaattaagatggattgagatcttagttgttaaggtagaagcaaaagcaccaccactgaatcctatactttaaacggtgatagcagcagttgtggtcttcgatatcttagtgtgttacttggtgatagcagcagttgcgatctccaatattctagggcatgtttgcctccctcttctaaacttagagatctaaaagctttacaatgttttagatttcttttgatgtccaaatctctaatgtaaggtgggctaaaggttaaagccaactttagaccacctgatgcatataaggaagaagggtccacatgcaccattctctgtagcatagcaaaatcgagcttgatgtccttgaagattgatcgagataatattagtcagtactgaatttaattttaatgacaagtttgtaatgggtaggataataagggatatgttacaggttgtttgtttcttggatgaatatgctgctgcatagggttaggcctgaaaggagaaacataataggattggtttttgtagctctcctcccctcatctctccatgggattggaatatatataactttatgagtttatatggaaagcaatagatattgtttatttcctctcttctctcctctcctctctatgccatattactgcttttaaactaaggcgacgctgctagaggcactattatatgtcaagttcatatattaagaatttgaactctagcctattgatgatgataattgttcattatctaaaattcctctatttgacctctatatatgtctgaaattcctaaacaacattatgtccatgtttgtgtgttaatattttttggtcattatgtcatgagtttgtgttaataatctgaatactaaagcatgtggtaggcaccattatgtctaaaattcctatacacattgcttatgattgtttgaggattacacctgtcttgagtttttatattaataatctgaatagtaaggttcgttgtaccttgtaacacctgagtttagttgttggctctgaactctgaaaaaatttattttttaccaaatacaacatcagatgtaattttactactgtgattaagttgtatcacatattcacagtagtattattgtgttcttcaagcaagtcaattacagtgagcttttagtcatgaatttacagtagtctatgaaagatcattcttgaatttttgcctttaaattgtcttgttaaatcttgtataatacactactaggtgagtgctcgtgtgtcaccggcccgagtttctcttcaacgtcatcccggacggctcatggatgtacgaatcaagctgaacatcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacctagagtggattttagatcaccataaaaaaaaaccatacctcacacatcgcaaaacacccccgagagccccccctgcccccagcccgatccttctgacaccctccaccaaacatgaccgttggtggaggctgtctgtcgtatggtgcaccggacagtccggtgcacaccggacatgtccggtgcgccagccacgtcaccaatgccgttggattccgaccgttggagcttctgtcttctgggcccgcctgggtgtccggtgcacaccggacatgtactgttcaatgtccggtgcgccagtatgggcgtgcctgacttctgcgcgcttttggcgcgcattgaatgcgcctgcaagtgaccgttgccgcgaagtagccgttgctccgcggatgcaccggacagtccggtgtacaccggacatgtccggtgaattatagcggagcagacgttcctggtttcccgaggctggcgagttcctgaggcagctcttctttggagcaccggacatgtccggtgtacaccggacagtccggtgaattatagcggagttgcctctggaaattcccgaaggtgaagagtttgaagtcggtcttccctggtgcaccggacatgtccggtggtgcaccggacatgtccggtggtgcaccggacagtccggtgcaccagtccagggtgccttcggttggccctttgctcctttgttgaatccaatatttgatcttttgattggctaagtgtgaaccttttacacctgtatagcttatacactagagcaaactagttagtccaattatttgtgttgggcaattcaaccaccaaaattctttaggaactaggtgtaagcctaattccctttcaggtgcgactaagtcagggatcggtccattcgagggactcgatcatgcctcgcccgagcctagcctcgggcaagggcagccgaccctggaggatctccgtctcgcccgaggcccccctccagcgacgaacatacttccggctcgctcgaggcccagtcttcgccaagaagcaaccctggccaaatcgccacgccaactgaccaaatcgcagggacatttaatgcaaaggtggcctgacacctttatcctgacgcacgtcctccagtcgacagagccgaagtgaccgcagtcacttcgccgctcctctgaccggcctgacagaaggacagcgccgcctgcgccgctccgactgctgtgccactcgacagagtgaggctgacaggcagtcaggcccggcctcaggcaccataggaaactccacttcgcccgacccagggctcggactcgggctcagccccggaagacggcgaactccgctccgcccgacccagggctcggactcgggctcagccccggaagacggcgaactccgctccgcccgacctagggctcggactcgggctcagccccggaagacggcgaactccgctccgcccaacccagggctcggactcgggctcagccccgaaagacggcaaactccgctccgcccgacccagggctcggactcgggctcagccccggaagacgacgaactccgctccgcccgacccagggctcggactcgggctcagccccggaagacgacgaactccgtttcgcccgaccctagggctcggactcagccctggcctcagccgacggtctccgcctctcccgacccaggggctcggactcgacctcggcctcggaagacagacttgacctcgacctcggaggagcctccacatcgcccaacctagggcacagaccgaccacgtcaacaggaggcgccatcattaccctaccccaagctgactcaggctacgggaaacaagaccggcgtcccgtctggctcgctccgccagacaagcaatgatggcgccccacacgctttatgacgacagcggctctcagtccccttacggaagcaagaggacatcagcaaggactcgacagccccgacagctgtccttccgccaggctccagcgctcctccgacggccacgacaccacacgaaccgggtgccaaaacctctccggctgccacgatggcatgtacttagggcgctagctctcctccgctagacacgttagcactctgctacacccccccattgtacacctggatcctctccttgtgtctataaaaggaaggaccagagctctcttagagagggttggccgcgcggggaagaggacgggacaggcgctcgcgtgaggccgctcgctcccctcccgcgtggacacttgtaaccccctactgcaagcgcacccgacctgggcgcgggacaaacacgaaggccgcgggatttccacctctctctctcgcttcggctgccttccccccccccccccttcgtgctccgtctcgcgccgacccatctgggctggggcacgcggcgacatttcactcgtcggcccagggacccccccggtctcgaaacgccgacagttctattacaaaagacattctcactagaatcaatgttcatgctcaaggctggcgatcaatctaccgcatgcctaagcgaccagctttcaagggatctgctcctatcaacctttcgtatcatttgaatcaagtcttcggtgggcccttggttccattgaaattcttttgagcaggcatttgaatagtcgaccagctttctatgttgtattgctctaccatagcaaatcaggtagctggtattattaaatatattgctgatgttgtattgctctattttgaagccgtattgttattactgagcaaataagggatcgacaaatataatttccttcctttttagattaggggtaaatatagcctcctactatttagagatgaaatttatgtgtcttggttttccttatataacctcctatttcaattattgagaaacaatatatgttaacttgtcccaatttgttataatactggaaataaaggggacaccttctataatgccttgtgctcaatactcctagcattatgtgactcaggaactaggcggattaaatcattataatattctctcttcaaaatttgttggagacaattttgacatgatttttttccttttttaggaacaatatgcttctgtgagggagatacaatggggcactttcaggaagtattcaggggatcgtcgcaacagcgtgagctggaactacaagtaacaactcttaaagagcagctccaagaagctgagatccattataagcaagacatgatttttctccaagttttcattttgcgctctatgctaattcacatgtttcctattcgacctaatagagattgtggttgtgtactcaagatcatttagatattcctataggttctgagaaaaactaatattgttcttgtggccgaaagaagaccaaaaaactttagttctctaaacttctttggagacactactgccattttccaaagatctcgatcgctaacactttaatacgtttgcatccttcaatcaatgttactctctctataaatagttggaccaaagactaatcctatatgtcgatcatatgcatgaaagagttaacacttttccaaactggcgttgtcgatcaatgtcatatgtgaaggtatcgtcgtctaatctacaaagtcattcatttaattgtgtgtcattgcaatgcctataatatatgtggtgttcgtttttatgtaattattgtgcactaacattttattgagtattttgtatgtcgttacaacgcacgggcacctgtcattaaaagttttatattcactcttcagaaataaatttttgttatattaataatgtttgccacacggattctggatataatagtgatgtttgtcgttccgtatctatgttttatataaattttttacttccgtagcaacgcacgagtacggacctagtaaagatttgaatcataattgttgatcataaacctatatacatacttgtctagccaacaaaacatatgtctttatattttatattctatactcaagtataaataaaaacaatagatgtataggcactttactagtatgcttaacacaacataatgtgaacaagactcatttataggttgatacatcctaactagggatggtaactaaggatggaaacgaacagggttggtggaaatagtctttctctcctatttatattttcacattttatttcggaaactgggtcgaaaacgagaccattgaaaacgggaaaaaaacgcgactagcgggatgaagaaaattaactaaaataaacgaaataaatcgataatggatcagatccggactaaaaacggaaacatcgtcgcatagagtataaaaataaagtagtattatgagtaattgaaatatttcatctaaacgtataaaaacaatgtattataatatacatatgaatagcaaagaaaaatgataattaaataaagcgtgtcgttgggttggacccgtttcttgtttggttttagtgacagattgaacctagttttttgtttgattacagggttaaagtgggttagcgctgcaccatctattgtttatttcgtggtgatggatggactaaatatggtcacattcctgatcatattaccacactcagaatgacatcttcaatttaatgatatgacatcattcaaaaataaaaatgacactgttttaatatttgaggaacctataagcataaggtataaataaattaaaacaattatggactaagtcgtaaattttagtgacgagttctcagtgttacattttagtcataagtaaagaaacatcccaacaacatcaagatgcatttcattgaatttgaaacatttgtcatcactagcagacttgtctaggcggtgacgaatactgaccctgttcgacaacagcactagcaaggctcgcgggttgtgcctactagagaacacgccggtatcgaagggtaggccagcggggactgacaacgggaggcggtggggattgaagtaagagggtaggtcggcggggtccctcgtcccagcaggccggcagcggcgacacgctcctgtgctggtctcgagtagataatgcatgggtgacgagagggtggagaggaagtgggtcgaaatggttcgcttgttttttaggaatcactagaacccacatttacaataagtatttcgacctataaccaacctaatccgcgagccttttgaaccaaacacgagttgttgtgggttgaacctgttcaaacccgcgtcaacccgctaaccaaacacaccataagacgtgatatattgatacacatgtacatcgatacagtgatatagtgataattaaatgtatttcttggcctttaaatcagatgtgattacaacttatatactaggacggagggattagattgttcaaatatctcagctaattctagtatctaactattaattctagtgcatttaaacactcttagctattaatattaggtctaaacttttaaacttttagcgtattcaaacacgcccgctagcatgatagcccatttcttaggtttcggcgcctcagtgggacgaaactcactggctccctctcctcccccagtccgcggcgctcgctccgttcacctcggccgcggcgaccttcgaggcgacgagacgatgctgcggctctcccgcttcctcccctccgcctgcaggtgagccgcgaccctccctaactctatcgctccccacgccccgcttttcggagcggcagccgccgcggtgccattcctttatccatgtgcagatgtgcttaaccgggcgcgatgttcggcgctcttggagccactagcatgggttttcgatcgggtgaactgtcgcgcgtacggtactgctacgcctgctactgtagtcagggtggcttctgcccggggtttcggtggggggtttaggggtagggtttatgcacaagcgtgtcgttcttgttgacctcgcttcctcgacgatgtcttttctggtaggttcagatttcgctgtaaaggaggatttccccgcttcccttgcgcgtgcggattgtgcacactcctgtgcgatatcctgggggtgatgaacgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatttcaaatgctctttgactaacaaaaactccccctaaatgagatcctcctctagtgtcaagagggttttgatatatcactactttctcccctttgaacacaataagataccaatgaaatactctttgaaaaactaagttttgaaattggtggtggtgcggtccttttgctttgggctcttactttctccccctttggcatgaatcgcaaaaaacggaatcattagagccctcgaagtactttcttcccctttggtcatgaataaatgagttaagattataccaaagacgaagtccttttgctttctcccccaaagatggggagttgcttggagtgacggcgaaggatgagtttcggagtggaagcctttgtcttcgccgaagactccaattccctttcaatacacttatgacttggtttgaaatagacttgaaaacacattagtcatagcatagaaaagagacatgatcaaaggtatacgtatgagctatgtgtgcagattagcaaaagaaattcctagaatcaagaatattgagttcatgcctaagtttggtaaaagattgttcatcaagtggcttggtaaagatatcggctaattgatctttagtgttaatgtaagcaatctcgatatcccccttttgttggtgatccctaagaaaatgataccgaatggctatgtgtttagtgcggctatgctcaacgggattatccgccatgcggattgcactctcattatcacatagaaggggaactttggtcaatttgtaaccatagtcccacagggtttgcctcatccaaagcaattgtgcgcaacagtggcctgcggcaatatactcggcttcggcggtagaaagagcaaccgaattttgcttctttgaagcccaagacaccaaggatcttcccaagaactggcaagtccccgatgtgctcttcctattaatcttacaccctgcccaatcggcatccgaataaccaatcaaatcaaatgtggatccccgagggtaccaaagcccaaacttaggagtataagccaaatatctcaagattcgttttacggccgtaaggtgtgattccttagggtcggcttggaatcttgcacacatgcaaacggaaagcataatgtccggtcgagatgcacataaataaagcagtgaaccaatcatcgaccggtataccttttgatccacggacttacctcctgtgtcgaggtcgagatgcccattggttcccatgggtgtcttgatgggcttggcatccttcattccaaacttggttagaatgtcttgagtatactttgtttgacaaatgaaggtgccctcttggagttgcttgacttggaatcctagaaaatacttcaactcccccatcattgacatctcgaatttttgtgtcatgatcctactaaattcttcacatgtagattcgttagtagacccaaatatgatatcatcaacataaatttggcatacaaacaaatcattgtcaagagtcttagtgaataaagtaggatcggccttgccgactttgaagccattagcaataaggaaatctctaaggcattcataccatgctcttggggcttgcttgagcccataaagcgccttagagagcctatagacatgattagggtactcactatcttcaaagccgggaggttgctcaacatagacctcctccttaattggtccgttgaggaaggcactcttcacgtccatttggtagagcttgaagccatggtaagtagcataggccaataatatacgaattgactcaagcctagctacgggtgcataggtttcaccaaaatccaaaccttcgacttgtgaataccccttggccacgagtcgagctttgttccttgtcaccacaccatgctcatcttgcttgttgcggaagacccacttggttcctacaacattttggttaggacgtgggactaaatgccatacctcgttcctcgtgaaattgttgagctcctcttgcatcgccatcacccaatctgaatcttggagtgcttcctctaccctgtgtggctcaatagaggaaacaaaagagtaatgctcacaaaaatgggcaacacgagatcgagtggttacccccttatgaatgtcgccgaggatggtgtcgacagggtgatctcgttggattgcttggtggactcttgggtgtggcggccttggttgttcatcctccttgtcttgatcatttgcatctcccccttgatcattgctgtcatcttgaggtggctcatttcgttgatcttctccttcatcaacttgagcctcgtccttattttgagttggtggagatgcttgcgtggaggaggatggttgatcttgtgcatgtggaggctcttcgtattccttaggacacacatccccaatggacatgttccttagcgctttgcatggagcctgttcttcacctatctcatcaagatcaacttgctctacttgagagccgttagtctcatcaaacacaacgtcacaagaaacttcaacaagtcctgaggacttgttaaagactctatatgcccttgtgtttgagtcatatcctagtaaaaatccttctacagttttaggagcaaatttagattttctacctcttttgacaagaataaaacatttgctaccaaaaactctaaaatatgaaatattgggctttttaccggttaggagttcataggatgtcttcttgaggattcagtgtagatataaacggttgatggcgtagcaagcggtgttgaccgcctcggcccaaaaccgatccggtgtcttgtactcatcaagcatggtttttgccatgtccaatagagttcgattcttcctctccactacaccattttgttgtggggtgtagggagaagagaactcatgcttgatgccttcctcctcaaggaagccttcaatttgagagttcttgaactccgtcccgttgtcgcttctaattttcttgatccttaagccgaactcattttgagcccgtctcaagaatccctttaaggtctcttgggtatgagatttttcttgcaaaaataacacccaagtgaagcgagaataatcatccacaataactagacagtacttactcccgccgatgcttatgtaagcgatcgggccgaataggtccatgtgtaggagctccagtggcctgtcactagtcatgatgttcttgtgtggatgatgagtgccaacttgctttcctgcttggcatgcgctacaaatcctgtctttctcaaaatgaacatttgttagtcccaaaatgtgctctccctttagaagcttatgaagattcttcattccaacgtgggctagtcggcgatgccagagccaacccaagttagtcttagcaaccaagcaagtgtcgagttcagctctatcaaaatctaccaagtatagctgaccctctaacactcccttgaatgctattgaatcatcacttcttctaaagacagtaacacctacatcagtaaacagacagttgtagcccatttgacataattgggatacggaaagcaaattgtaatctaaagaatctacaagaaaaacattggaaatagtatggtcaggtgatatagcaattttacccaatcctttgaccaaaccttgatttccatccctgaatgtgatagctcgttggggatcttggtttttctcatatgaggagaacatcttcttctcccctgtcatgtggtttgtgcacccgctgtcgagtatccaacttgagcccccggatgcataaacctacaaaacaattttagttcttgactttaggtacccaaacggttttgggtcctttggcattagaaacaagaactttgggtacccaaacacaagtcttggagcccttgtgtttgcccccaacaaacttggcaactaccttgccggatttgttagtcaaaacataagatgcaccaaaagtcttaaatgaaatgctatgatcatttgatgcaataggagttttctttctaggcaacttggcacgggttggttgcctagagctaaatgtctcacccttatacataaaagcatagttagggccagagtgagacttcctagaatgagttctcctaattttgctctcaggatagccggcagggtacaaaatgtaaccctcgttgtcctgaggcatgggagccttgcccttaacaaagttagacaagtttttaggaggggcattaagtttgacattgtctcccctttggaagccaatgccatccttgatgccagggcgtctcccattatagagcatacttctagcaaatttaaacttttcattttctaagtcatgctcggcaattttagcatctagtattgctatatgatcattttgttgtttaattaaagccatgtgatcatgaatagcattgatatcaacatctctacatctagtacaaatagaagtgtgctcaacggtagatgtagagggtttgcaagattttaattctacaaccttagcatgcaacatatcattcttagttctaaggtcggaaatagtagtattgcaaacatcaaaatctttagccttagcaatcaaattttcattttctactctaaggctagcaagagaatcattcaattccttaatcttagcaagcaaatcatcattatcatttctaagattgagaattgaagcatcacaaatatgagaatcaaccttagtaattaatctagcattttcatttctaaggttgtctatagtctcatggcaagtgcttagctcactagacaaattttcacatttttcaacttattgagcataagcatttttaaccttaacatgccttttattttccttgattaggaagtcctcttgggagtccaagagatcatccttctcatggatggcactaattaattcatttaatttttctttttgttgcatgtttaggtcggcgaaaagggtacgcaaattattttcctcatcactatcattatcatcactagaggattcatatttagtggaggatttagatttaaccttcttccttttgccgtcctttgccatgaggcacttgtggccgacgttggggaagaggagtcccttggtgatggcgatgttggcggcgtcctcgtcggaggaggactcagtggagctctcgtcggagtcccactctcggcaaacatgggcatcgccgcccttcttcttgtagtacttcttcttttctctcctctttcccttcttgtcgtcgcccctgtcactagatataggacattttgcaataaaatgaccgggcttaccacatttgtagcacaatttcttggagcggggtttgtagtccttccccctccgttgcttgaggatttggcgaaagcttttgatgattaaagtcatttcctcattgtcgagcttggaggcgtcaattggttgtctactcggtgtagactcctccttcttttcctccgttgccttaaatgccaccggttgtgcttcggacgtggagggttcgtcaagctcgttgatcttctttgagcccttgatcatacattcaaagctcacaaaatttccgataacttcctcgcgggtcattagtgtgtatctaggattaacatgaattaattgaacttgagtggggttaaggaaaatgagagatcttagaataaccttaaccacctcgtggtcatcccacttcttgctcccgaggttgcgcacttggttcaccaaggttttgagccggttgtacatatcttgtggctcctccccttggcgaagacgaaaacgaccgagctccccctcgatcgtttcccgcttggtgatcttggtgagttcatcaccctcgtgcgcggtcttgagaaggtcccaaatctcctttgcattcttcaacccttgcaccttgttgtattcctccttgcttagagaggcaaggagtatggttgtggcttgggagttgaagtgctcgatttgggccacttcgtccgtatcatagtcttcatcccctacggatggtacctgtgctccaaactcaacaacattccatatacttttgtggagtgaggttagatgaaatttcattaaatcactccacctagcataatctttgccatcaaaggttggcggtttgcctaatggaacggaaagtaatggagtagatctagatgtacgaggatagtgtagggggatcttactaaacttcttgcgctcttggcgcttagaagttacagacggcgcatcggagtcggaggtcgatgttgatgaagtgtcggtctcgtagtagaccactttcctcatcctcttgtgcttgtcgcctttccgatgcgacttgtgagaagaagatttttccttcttctctttgtggtgagaagaggaagatcttttctccttccgtttggaggagtccttcttcttctccttcctcttggtgcgggactcttccgatgaagtgctcccttggcttgtagtgggcttgtcgccggtctccatctccctcttggtgtgatctcccgacatcacttcgagcggttaggctctaatgaagcaccgggctccgataccaattgaaagtcgcctagagggggggtgaatagggcgaaactgaaattctcaaaaataatcacaactacaaaccaggttagcgttagaaatataatagagtccacgagagagagggtgcaaaacaaatcgcaggcgaataatgaagtgagacacgcggatttgttttaccgaggttcggttctctcaaacctactccccgttgaggaggccacaaaggccgggtctctttcaacccttccctctctcaaatggtccctcggaccgagtgagcttctttttctcaaatcacttgggaatcaaacttcccgcaaggacgaccacacgattggtgtctcttgcctcaattacaagtgagtgtttgatcacaagaaagaatgccaaagaaaaagaagcgatccaagcgcaagagctcaaatgaacactacaaatcactccctctagtcactaaggctttgtgtggagttgggagaggatttgatctctttttggtgtgctttgcaatgaatgctagctcttgtatagtggttggaagctggaaaacttggattcaatgaatggtggggtggttggggtatttatagccccaaccaccaaacatgaccgttggtggaggctgtctgtcgtatggtgcaccggacagtccggtgcacaccggacatgtccggtgcgccagccacgtcaccaatgccgttggattccgaccgttggagcttctgtcttctgggcccgcctgggtgtccggtgcacaccggacatgtactgttcaatgtccggtgcgccagtatgggcgtgcctgacttctgcgcgcttttggcgcgcattgaatgcgcctgcaggtgaccgttgccgcgaagtagtcgttgctccgcggatgcaccggacagtccggtgtacaccggacatgtccggtgaattatagcggagcagacgttcctggtttcccgaggctggcgagttcctgaggcagctcttctttgaagcaccggacatgtccggtgtacaccggacagtccggtgaattatagcagagttgcctctggaaattcccgaaggtgaagagtttgaagtcggtcttccctggtgcaccggacatgtccggtggtgcaccggacagtccggtgcaccagtccagggtgccttcggttggccctttgctcctttgttgaatccaatatttgatcttttgattggctaagtgtgaaccttttacacctgtatagcttatacactagagcaaactagttagtccaattatttgtgttgggcaattcaaccaccaaaattctttaggaactaggtgtaagcctaattccctttcaatctccccctttttggtgattgatgccaacacaaaccaaagcaaatatagaagtgcataattgaactagtttgcataatgtaagtgtaaaggtagcttggaattgagccaatataaatacttacaagatatgcatggatcgtttctttatttttaacattttggaccacgcttgcaccacatgttttgtttttgcaaactcttttgtaaatcctttttcaaagttcttttgcaattaatcaaaggtaaatgaataagattttacggagcatttttaagatttgaaattttctcccgggatttcaaatgatcctttgaataaacaaaaactccccctaaatgagatcctcctcttagtgttcaagagggttttgatatatcagtactttctccccctcttgaacacaataagctaccaaccgaaaataatgtgttcaaaactaagtaatgaaatcggtggtggtgcggtcgatatgcacgaatctctagatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaatcgagaccacgcacccccccggccaaagccgaaagtgaccagccgtcattcgccgctccattgacccggtcggacaaaaaggacagcgccgcctgacccacttccgactgcagtgccacttgacagagtgagactgacagggcagtcaggccttgccaaaggtgccataagaaactccgctccgcccgacccagggctcgaactcgggctaaagccccggaagatggcgaactccgctccgcccgacccagggctcggactcgggctaaagccccggaagacggcgaactccgctccgcccgacccagggctcggactcgggctaaggccccggaagacggcgaactccgctccgcccgacccagggctcggacacgggctaaggccccggaagacggcgaactccgctccgcccgacccagggctcggactcgggctaaggccccggaagacggtgaactccgctccgcccgacccagggctcggacacgggctaaggccccggaagacggcgaactccgctccgcccgacccagggctcggactcaggctaaggccccggaagacggcgaactccgctccgcccgacccagggctcggactcgggctcagccccagaagacgacgaactccgcttcgccccgaccccagggctcggactccgccctggcctctgccgaacaacctccgcctcgcccgacccaggagctcgggctcggcctcggccatggagacagattcaaccccgacttcggaggagcctccacgtcgcccgacctagggcacaggcccaccacgtcaacaggaagcaccatcatcactctaccccgagccgactcgggccagagagaacaagaccggtgtcccatctggctagctccgccagataggcaatgatggcgccccgctagccctgtgacgacgacggctctcagctcccttacggaagcagggggacgtcagcaaggactcaaccgctccgacagctgtctctccgccattgatcctccgacagccacgacatcacaccagcagggtgccaagatctctccggctgccacattagcatgtacttagggcgctagctctcccccgctagacacgtagcactctgctacacccccattgtacacctggatcctctccttacgcctataaaaggaaggaccagggccttcttagagaaggttggtcgcgcggggacgaggacggggcaggcgctctcttggggccgctcgcttccctcacccgcgcggacgcttgtaaccccctactgcaagcgcacccgacctgggcgcgggacgaacacgaaggccgcgggatttccacctctctcacgcccgtctccggccacctcgcttccccccttcgcgctcgcccacgcgctcgacccatctgggctggggcacgcggcacactcactcgtcggcctgagggaccccccagtctcgagacgccgacaagtagatattaaagacttaaaaaacaaaaaggtttacaggcaaaccagacaaggaaacatcaattcatatctcaacatttcttagcaagtaatagcacaagcatcaacaacactaatgttacaaagttataactacatgaatcattacctcagttcccagacagttttgtcctcatagctatagctgatgacatgaatagcttcttttagaagagactctagagttgcagattgtggaacaccaccatattccactagagtagagactacaaaaacattggactggccaaatctcttctccaggctcatttgagacatatttagctataatctcttctctaggctcatttgagacataatcaactatttctccatcaaatacgacaagagaaatagtcacttgtatttgataagctatttatgtaagcgctttccatgctttggaacaaatgatctacatagtcaaacataccaccctgcacaagtgttagacaaacataaatgtaaataaataatgtgacaagatcccttattttgaattatggtgaaatacgacaagagaaattatgaattgacaaattcgcgaataatgttttaaaaataatagctatgtgctcgaattttaaggaaacaatgatagctatgagcaaagtgacaacccgaaaatttagatgcgaagatgtaaatggctcgagcctaagcatgtaatgaagaatgattcccatgttagagtagtgagatatgtaataaaaactttaggagtctaaccatggttgtaaaaggattacattggacgaccgtagaactgtcgagactggtgctttataatagtaaaaagtaattaacagccggagagtcgcttatccccctcaactggctaaaccccatcattagtttctctaagattctcctacggttagtgccacatcaatgcatctaagcaaatttctgaaggcatatagatatggacaatatgattaagaaaacaggaagattcatccttgcctatcgttatgacaaataaaataataattcaaggagttggaatgggtggctcttggcttcacatatccatgtactggacaactgatctacacttagttttctaaactaaacctgcagaaccattatgtcatttcaagaatctgcttcagaagaacattagtaggaaattgagcttctaaagactgtagtgatgctgcctactaaagtggtgaggtgattttactacgtactgtgatgctacactgaaataatggttttgtcggttgcggtttttttattctgcagctttgctaatttggattttaccccggtcactctcataattaacaagttcaatcctcgacactaattattaccccgtgcttataaaattcaaccaagaccaaacaaatctaagacataatatgttgaatttccacccaaaagaaagaaagaagtttgtttattagtgattctggaacagaacgggacaatggaggtttaccattgtggagtggtcacaggcgtggagcgggcagcgccagcggttgtcggccgatcaggggcggctgagcttgagctgggcgttgttggcctacggctggtcgctgcgtcatggcttgtaggcctgcgcgtgggcgaggaggtcgttgctgccaccgaggctcttgttctgcttgcgcttgcgcatctcgcggatcttggagaagtccatggagtagtccagcagtgccctgttcttcgtgttctagtccccgaacgtcggcacagtcatccaggcgttgttggcgctcgcatcctcatggcctcgctgctgcatgcaccaccaatgcacggggtcagtgagaactaagaaggatgaacacatgcacggatcgcgctagcggtaggaacccaagaccaagcctaacaaataaaggatccagggaggcagagatcgctagcccatcttacctccttaaggttgtccatggatgatggacggatgatccctccctgtcaatttgcgtgagtctctcttgttcatgtccttgccttgttgggtttgcgcgtgtcgtatgaagatgtggagtgaattcagcggtcagctcaacaaccatgacgcggtggggaagaggatgcaggaactatacctcgaaggttggggggggcgacagcgacgaccgatggatgatgccttcgggccgacgatggtgcggacgggaacaaaggcggcggcacagaggcgacaaaagcctacctcacgtgagaaattgagaattggaggggactcaggagtgggcagaacggggggcggggtcgacgcacgtgagccgtcagatgatacggacggtactgattgacgagaggcagaacggcagaaccatggtgcacggatggtctacaatagagtcttatagagtagtagagatttgtgtatttaaacgtgggaacagagaaccgtatatggtttctatgagctcttaatgttcaatctgttgagaactatgtcaccacggatcaccagatccactcccttccctcccgtcagcagtagaggcgcgagaagctgtagaagactcgtctcccttcccataagcacgacagaggaaacacacaagacacatgatatagggttgggcctctggcctctttctgatctctctgtaatatgaagaggtgtacaggttccttatatagagatgtgagacccctcaggggcaaagccggtatttgcccacataaccctaactagggttacttaacactcccccttgggcgaataccacgaccaacacatgcctcgttaaaattccgaaaaaacccagtgggaaaatatagagaaagagtgcatggtgatacaaattgcatttgcactttattgcctcgttaaaaacctcatgtgagaaacttcaagaaaactcaccaagggaaaaagagtacaacaactgtcatcgtgacagattttgatcctctggaatctagattctatcgaatcttctacaagggctaactttagaaatgtgctccccctgatccttgcaaaactgtatcaataaggcaaaacatcttcttctggaagtatatgcacataaagatttagcaaacagattgcatatccttgcaaggactatttcaggaattttacctctactcacttctaggatatacgaggtaagtgcacgtatcaatataaataagccactttgactgatggtgtttgatcgactggatctatatatttgatagaaagttccataaatgttcacatattgatcatcatgctcacgccttcagggcatagaatatgacatttattgtctcacgattgtgatcaatacaagcattcgctccccctaacgatgacatctatcaaagtcgttatccctcataactcaagcatattcttcaagatatatgtctcattgttcatctggaataacgagaatggatgaggttggggtgctatcattttctatcttacaccacaatttatacatagttgtgcaaagcaaataacatgtccttcaataggacttaggggataatatagttgtaatagtacatattctaaatatgacacatcactccaggcgttcatccattgcaacatctatgatggtgtaacaaaagtccatcaaagatcgtaatccattagggatttttcatcaatcagatacatcgttatagtctgtcattctggcacaatggagatattttgccactaacacctaaaccttataggtttatgccattagggctttagaggataccgtaattccacatctagtggaaattaccatgagtaaaactcatggaatgcacatgtgcttattcgatgaacttcaagtcctttggtacctcatcttattccttttcgggtctatatgggtctttatccctttatagggattatcaaactttggtgttcaacacagactttgtttattctggataggttccatctgggaacgatagtctcaactacgagatattctccctacataggagagtgatcattcatcaggaatgtattattcggtatgagatttatatgttgcatatttataattcaaatatatgagtcctcctaggatctcatgacggatcttcagaatcctattaactacatattttaattcatgccatttgccagatatattacatagcggaacagtgtttattcaacacatacgtgggatgggtctctcacaagaccacttgaaccatcgtattcaccacacattatttcaatagtgcccataaatgtctgaacttcaagctcgcgactttcattttgcaattattggttcagcctcgattgcatttatcaatgacccgataagagagcttaaagcactcatgcctaggactttgttttggatccatttgcaatctagagggggaatataggtgtcgacatatttgtctcccacatttaatgacgatcttcgttatttcccaaaacaaaagattcattgttctgtattcctagcacaatgatattgcgcgcattgctagaaatttcatcatcaagatgaacctcttcgcgaggcaaatcaccagcagggcgagttcaccggaggagagttattacagaccacgtgaatctgcaatcagaacatatgctttgactaagaccaatggatcatattcacaggcgtccccgagaatagatcaaatgccaataagtcaaatgtggatacaatattaatcccgagtatatccacatctacatcaggtagaagcattcagaccaatatggttactcctcaatgatttctggcaaactccatatacataggagtacacaccgaacgacagattcagtttggcttttgtgcgtttaatagaatattgaggcattacattatatgggcattcctccccctaatgtcgagatgttctaaaagcatacatataaaatccccaaccacaatcatctagttgtggccaatgtatgctattgtggtgatttatttgggaaatcttacgcacattacggatcggggttttatgcagtgagctttggacttagattaatgtagtgacatgaatactacatatttttccttcaacatgaagggttagtctcaacatccaacgagacacgcaacaacaagttgcttcatggttacaattctgcaaacttattgttattactaccaaatgcatagtcaatctttaagatttagactgatatgtgcaacaccattttatccataagggtccttcaggggctcatgcataccattcgtcgtttggagtcattagttgacttcagatcaacaagtaaaatgaccatcatggtctaacactcacaaagacattcactggttgcattgtgcgtttaagcacataggaaaatatgtgtgtagataatggtagtaaagtgcacggcatcaggccaatgttgccaagcaaatatttttatatgcatagatgtatagtccagctcgtttttatcactgcccatggtttacccaattactcatactgttctgaaattgggtatcgatttatgcaacatttttaggtataataattttgagagagaacttataacaatagtcaattattaatggtgttgccagcatggcaaatatttctcctcatattatataccaacttgttctataaagcattatttcgatctcttcattgttcagcaaaagagaagctttggaatagaacagacaaggccaagaaaacattttatctgggaaaaatcaccatataactagcttttgatgaagcaaatgatgataactgcttggcaagaacgaaacaatactggtatccgcctaggatccatcttcaacaacagatagtactgctctcgtacgaagaaatcatcaggagtagagaggatacaacaggtctctacaagatcttcatatttctatcacaaattatcatcactagtagtctagtggtcaagacatatgactcttctggctccgaggaccaaggacatgttaatgtctaatttagcttcaagctctgttgtgatgtgggattttatagttatttgtctacttttctcacttctggtagatcggaggcagataatggtaagcatgccaaagggtggaattcagtgtagttcggctacctaaaccccaggtatgtgtccattcaggaccgacctttaccatttagcttacagtgtataccaaacttgtcaaaggactatcctgagtcaattcagtgactataagtatttacaattccgagagatgtatgcgacacaagcatagaggtcctagatagaacgagtaaagtggttcgacaggaacatactatggttttcacaccaacacagtaaaatttttctcaaaataacctctcggtatactcgcaacttcgtgttgctagcggttacatgtccttttatctcatagtttgcttcatgtcatccagcgacaaagagagcaatgtgataacatctggttgagcaatgtatgactgagatttctgatcttaaatcatttggtaaggtctttttgcttactaatataatcccaatttgtgatatctttatgccaaaaaggctttcatgcattaatattgaatttcttcaggttacttcgggtaaaactttatgcacgaggagagagcagagatttaacttatctgtgtttcattgtatttcgatttaatttcccggatttactatagttgttatggccacttggtgatatatataaatatatgatgccacacaacacaatcaaacaaaatataaagtgaaaacaaaattgtttacgaaggttgcgtataatgtgactttagggggcttgaacaacccaccacaatccacgcgagtacaagctctagcgtctggtgtcaacgcgtgtgcggccatcagggctacgacaacacaacaagccttcgtaataagcgcaacaggcacaattatggctcagtaattgaggtacacaataagtccgcgcaacgtgcacaacaggcgcaattgtggctcgatgatcacggatgacagacaatgcctacagggtatgcgaaaaatacgcgactcagcaatgacggtctgactcaacaggagtgatccgattaatagagagcgcgacatagcaatcacatgacgcagccaagttcgtatgacacaaatattgcgtcatgttgctagggcgcagccaatagccaatgtcttaactcatccaattaataatgtaacctgatcggcacatctgtgtacccactatacaatttaatcgctcgacgtgagtccaaattccaaaagctcaacataatataaatatttagagcgatttgagtatgccttatatagactttacatgcattttaataattttctgctataataaataaaagcagaaaaataaacaccaaaattattgcatgagcataacacatcagcatttttcatatttaaacatgtatttctctactaattatttactgcaggaaataattaattaaagtagaaattgtaacataaaacatgctttattctttttgttatttacaatagaaaatatatagaataaataatatagagcatgtatacaaatttatataaattcaccaagaattttatttatataaataattaaattgagattaacgaccatttcgaaaataaaaccaagaaaggtcaaagaggagtcgttgcttcctgtgcatgagcaagacccacgaccgctcccttttttctgttgaccgtccatgcatgcacgatgcgcaacgtcacacggtttttctgtttcgttgcctcaacggccggctcggtagtcaatcccgcattgaagtttgaaatgcggacgttacggacgaatgggcctgccgggaaaccgtccagatcttcgagaataattaggctgggaatgggtcctcctgttctagcgggctctcgcaccaccgccacagccgaccatcatgattcatgtcgcggtgttgggtctcgtattacctttgctgcttgcgcgacgcggccccactgtaggcacaggcgtggcttctggcgtcggcacagctccggtgcggcgtggacgcttccagcgtggcacatgctcgagcgctggcgtagtctcaccgtaggcagactggcagaggcatgacattggagtagaccagctccagcaaggctccgatgcgagtgcttccggcacagacgcagcaccatgacggagacaacaagttggtggcgcacagatcacaccaacggatcaagaaaacataccgctcgattgcgtagagggagaatcgaaggctgtcgcgtaggacagttcggctaggccaaggacctgccggcgtgacgaagggttgatgcagatctgatctcgcagcaacgtcgaggtagagcgtgctgataacgtgttgagaactacgtcaccacggatcaccagatccgctcccttcccccgtcagcagtagaggcgcgagaagctgtagaagactcgtctcccttcccataagcacggcagaggaaacacacaagacacatgatatagggttgggcctctggcctctttctgatctctgtaatatgaagaggtgtacaggttccttatatagagatgtgagacccctcaggggcaaagccgatatttgcccacataatcctaactagggttacttaacacaattaacagaaacataaatttgctaactagtgaagttcaccacatggggctggttcgtgttgccaatttttcgaaacccatctatggcgaggtccgaattgcaaaaatctccagtcacaccacacgtcacgctcgcaccggcgggcgggcggcgccctgacggccgagggtcacgtcacacccaggcagcggctgcgctccagagataactagtgcggcggagggcgggatgctgctgctcaatccgtgtcctatcccaaaggttggctatagcggagtagcggttgcggcatctgctctctattttggccctaattactggttcaatattctgtcgtggttgcatccgcaccggcgcaccccatagagtctcgcttacattcgccctcggctccatctagcttgattttgtggtttggattaaggcagctttagcttaacatactggcctcccaaggtataagtggatctgctcccacacttcatttactcagttagcacatcaattcgcagacgttttattacagactaaatgttgcaaatgcagtcacacagtctctcagaaacgcatagagtcgcattaactcagtaaatcaacatagtccagtgactacatactcccatttgagtttatttcagtacagattattctgcgcctccactcataccatccatcgagtggagggcatgggctaaatgtcgctaacaatgagatgtgctaatcttgctgcctgctgctggcgccgctcgattgcattactcaagtttgaagctatgtctgtttattgttaggttctgttatgtacactgtgtatccataacaaggacacattaatacattattgtactacacttctactcaagtagcttcagccaaaataaatgtatctgaacaggaacatctggtcgtacaacactccgacaccgaagaacataccaaaggccaccgcaaagatgaccttatcggcgtactcttccgtggagacatcggtgactggaactgcatctgctgaattacagtggcgcatcagcgtagcgccgcacagctttgggtttccaaaaaagctagagtctggaaatgtgctaaactggcccccagttggaacaggcccttctagatcgttgctggaaatgttgaatttggaaaggaagtgaagcctctccagcacagaagggatttcaccggtcaaattattgtaggataagtctagcacctgcagattggtgaggttgccgactgattgtgggatctccccatgtaagttgttgaagctcaagttgagtgtaaggagtgcctgtagctggccaatctctggaggaattataccgttgaatttgttgtttcctagattcaacattttagggaagccactggttgtacggtattgaagaaacggtgccaggtagacaggaaacttaagtattattggggcagagtgagctgcctcaagcgttggcatctccatcagtgctgttggtatgtcaccagtgagattgttattggatatgtctagatagaaaagaaggtttaagctattaatccaggctggtattggtccactgagtttgttatcgtctaatagtaaagctcgcaagtttttgagcttagccagccagttaggtaacttcccatacagtggacatttatttatgccaagacccatgagattctcaaagccatgaaattcatcatcatctggcatggtctcatgcttgaagttgcccccaatcagcacgagagtgagtgtcctggacttactgaggatttgaagtgtatttctgatatttgtaaaactattgtgagcgagagctaggaatctgagggacttgagattgtttatccctgatgaaaattgaccatgaaggttgttgaaagataatcgcaacgcaataaggttgctgcaggagtagaggctctctggaattgttccagtgaatttgtttgacctgcaatctaaaaattttagattagacagggtggagaagttgacatggttgagatctccttggaagttgttgtctttaaggatgatggttgtgagatttgagcaactgctaagggctggtggcagctctccagacatgttgttattgtctaagtgaagctcctccagcctcttgagctgcccaatagaattcgggatcttgccatttagtccattccacccaagatcaaggatgaccaaatttctgagttttcctatacactcaggatcaagtgttccttgcaaatggttgttagggaaagagaggtgctctagtgaggtaacattgaagatctcagatggaagggtcccattgagttggttctggccagccttaagcactttcaaaccagagcaattaccaagctctgagggtattctaccaacgaactggttgtagctaaggtcaaggaccacaaagaatggtttgtcaacacaaattgtgctcggaatttccccagcaaagctattattgctcatattgagagcagccagattcttcatgccctccaatgtggtggatggaaaatatcctgtgaggaagttactcgagatgttcattaccttcatcgcgctgttaggcgtggattgcagctcatggaattctccactgagcttgttaaagctgacatcgaggacagtaatgctgctggagagcaacagtgtcgatgggagtccaccggagagcaagttgccagataggttgagcttcaacaggccgttgagattgccaagtgagggtgatatgtgcccctcaaggcccatagcagctagtgagatgtctatgatagttctatctccattgcaaatgacaccctcccatagacagcagtttgtgtcattctgccatgaactggtgaggccagaggcttgagagagaccattgaggaactcgaagagggatgtcttctcctcttctttgcaggagctggcaggagaggccaagaagagcaatagcacaagactaacaccaagtaaaggtatgtgtagcatttctgattttctattgttgtatgaatactggagtggctgcatggtctcttacatgaaacagggtaggacctcgcaaacacatcatgctataatatagcagcggcaacagaatcttgaaaagcttgcaaggatgttgttcccatattgcttttacaccttgtgttctcgtgattctgtttgtaacccttctgcaagtacaagttctgatatctagattcataagagcatctttctttttttatggtaacactctgactctaggtctcagtccttttttgttttttcttaatcttcgttcacggatgattagtgaatcatgtaaaaattattttactggaagaaaggcactgcaaatttgcaaggttgtattgttacttcaattgctaaagtcatacagactatttgctctgcatatttggtatttcatttgcaagagccatgaagactatctgttctatatgcagtggcatttcatgtgttggttttgtaaaatataaaccttgcaatgtttttctcattttccattttccaatatttttttgtggaatgtgaactgtactgattcgccaaaaacatattgtatgattgtagtgaaatgccgactgaatcaatttggaatatggatgcacccctgtctagagatttgggaagaaaatgagtacaaggtagccctgtagttcccagatgtaaagggaaccatggggcttgagtgtacgcaggacatacaggtatgttcttctaaactttgcaaatgttgcttttttctgaagctaattatttgaccacaggaataccaggtgggaataaggatatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcatggtacataaaagcatggttctttttagcactactagccataggagccttccctttctccttggcagagataggagccttatggcttgtcaagttcttggcttccttcttgtagccaagtccatccttaattgaggggtgtctaccaattgtgtaggcatcccttgcaaattttagcttatcaaaattactcttgctagtcttaagttgagcattaagactagccaattcatcattaagtttggaaattgaaactaggtgttcactacaagcatcaatgtcaaaatctttacacctattacaagtttcaacaatttctacacaagaattagatttactagctacttctagtctagcatttaaatcatcattaaaactctttaacttagcaatagtttcatgacaagaagatagttcactagagagcatttcatttctcttaatttctagagcaagagatttctgagcttctacaaatttatcatgctcttcatacaacaaatcctcttgcttttctagaagtatattcctatcattcaaggcatcaattaattcattaattttgtctaccttggttctatctaatcccttgaataagcatgagtaatctatctcatcatcatcactagactcatcctcacttgaagaagcataagtactagtattatgagtgcttactttcttctcccttgccatgaggcaagtgtgacgttcgttggggaagagggatgacttgttgaaggcagtggcggcgagtccttcattgtcggagtcggacgaagagcagtctgaatcccactccttgccaagatgagcctcgccctttgccttcttatagttcttctttttctccctcttgttcccttgatcctgatcactatcattgtcgggacagttagcaataaaatgaccaagcttactgcatttgaagcatgagcgcttccccttggctttggtcttgcttggctgtcccttgcgacctttaagcaccgtcttgaatcttttgatgatgacagccatctcttcatcattaagtccggccgcctcaatctgtgccaccttgctaggtagcgcctccttgcttcatgttgccttgagagcaaggggttgcggctcattgatcggaccattcaaggcgtcgtccacgtatcttgcctccttgatcatcattcgcccgctaacgaatttcccaagaacttcttcgggcgacatcttggtgtacctgggattttcacgaatattgttcaccaaatgaggatcaagaacggtaaatgaccttagcattaggcggacgacgtcgtggtccgtccatcgcgtgcttccgtagctccttattttgttgataagggtcttgagccggttgtatgtttgagttggctcctcgccccttatcattgcgaaccgtccaagctcgccctccaccaactccatcttggtgagtaaggtgacatcattcccctcatgagagatcttgagggtgtcctagatctgtttggcattgtccaagccgctcgccttatggtactcgtccctgcacaaagaggctagcaacacagtagtagcttgtgcatttttatgaatctattcattaataaacatgggactatccgtactatcaaagtgcattccactttctacaatctcccatatgctaggatggagagagaacaagtgactacgcattttgtgactccaaaatccgtagtcctctccatcaaaatgaggaggtttaccaagtggaaatagataataaatgagcattagtactttgaggaatacgagagtaatcaaaagaaaagttcgaattgaccggtttctttctctcgtattcgttgttgtcgtcgtccttttgggaggaagtagactcatcgctgtcgtagtagacgatctccttgatgcgtcttgtcttcttcttcttcccatctttgcgtctgtggcccgagcccgagtcgttggacttgtcattccttggctcgttgacgaaggactccttctccttgtcgttgatcacgattccctttcctttaggatccatctcttcgggcggttagtccctttgtgaagagaacggctctgataccaattgagagcacctagaggggggggggtgaataggtgatcctgtgaaacttaaacttatagccacaaaaaacttgttaagtgttagcacaataatcgccaagtggctagagagaaggtcttgcacaatacgataatcacaaagaattcaacacagagaagacatagtgatttatcctgtggttcggccaagtacaaaacttgcctactccacgttgtggcgtcccaacggacgagagttgcactcaactcctctcaagtgatccaatgatcaacttgaataccacagtgttatgcttttcttttcttatcccgttcgcgaggaatctccacaacttggagcctctcgcccttacacttttgatgttcacaaagaatcacggagtaaggaagggaagcaacacacacaaatccacagcaaaatgcgcacacacggccacgaatcgagctcaaaagactatctcaaagttctcactagaacagagctcgaatcactgagaatgacaaacgaatgcgcaaagactgagtgtggatgatcaagaatgctctaaggttgcttggtgtgctcctccatgcgcctaggggtcccttttatagccccaaggcagctaggagccgttgagagcaattctggaaggctgatcttgccttctgtcatcgggcgcaccggacagtccggtgcacaccggacactgtccggtgcccgatctccttcctaaaatggcgcagccgaccgttgcagatctgggagccgttggcgcaccggacatgtccggtgcacaccggacagtccggtgcccccttccgaccgttggcccggccacgtgtcgcgcgcagattccgcggccgaccgttggcccggccgaccgttggctcaccggacagtccggtgcacaccggacagtccggtgaattttagccgtacgtcgccggtgaattcccgagagcggccagttcgctcgagccagcctggcgcaccggacactgtccggtgcaccaccggacagtccggtgtgccagacagagctgagtcttggctgtacacagccaagcctttttcacctcttttcttttcttcttctttctgtttctaacacttagacaagtatattagtacacaaaaccaatgtactaaggcttagaaacatacctttactcttgatttgcactttgttcatccatgggcatagattcacatttaagcacttgtgttggcactcaatcaccaaaatacttagaaatggcccaagggcacatttccctttcagctgcccaacatcaccgactcagatgtcatcggcgcgttccttgccggcaccaccggccgcgacctggtgagcaagttgggtcgcaagacccccaccagggcgagcgagctgatggacatcgccaccaagttcgcctctggccaggaggcggtcgaggccatcttccaaaaggacaagcagccccagggccacccgtcggaagaggctcccgaggcgtctactccgcgcggcgccaagaagaaaggcaagaagaagtcgcaagcgaaacgcgacgccgccgacgcggaccttgtcgccgccgccgagtacaagaaccctcggaagcccccggaggtgctaacctcttcgacaagatgctcaaggagccgtgcccctaccatcaggggcccgtcaagcacaccctcgaggagtgtgtcatgcttcggcgccacttccacaaggccgggccacctccagagggtggcagggcccgcgacgacgacaaaagggaagatcaccaagcaggagagttccctgaggtccgcgactgcttcatgatctacggagggcatgcggcgaatgcctcggctcggcatcgcaagcaagagcgccgggaggtctgctcggtgaaggtggcggcgccagtctacctagactggtccgacaagcccatcaccttcgaccaagctgaccaccccgaccacgtgccgagcccggggaaatacccgctcgtcgtcgaccccatcgtcggcgacgtcaggctcaacaaggtcctgatggatgggggcagctgcctcaacatcatctacgccgagaccctcaggctcctgcgcgtcgatctgtcctccgtccgagcaggcgctgcgcccttccacgggatcattcctgggaagcgcgtccagcccctcggacggctcgaccttcccgtctgcttcggaacgccctccaacttccgaagggagattttgacgttcgaggtggtcgggttccgaggaacctaccacgcggtgctggggaggccatgctacgcgaagttcatggccgtccccaactacacctacctgaagctcaagatgccgggccccaacggggtcatcaccgtcggccccacgtacaaacacgcgttcgaatgcgacgtggagtgcgtggagtacgccgaggccctcgccgagtccgaggccctcatcgccgacctggagaacctctccaaagaggtgccggacgtgaagcgacatgccggcaacttcgagccagcggagacggttaaggccgtccctctcgaccccagtggcgacacctccaagcagatccggatcggttccgggctcgaccccaaataggaagcagtgctcgtcgactttctccgcgcaaacgccgacgtctttgcgtggagtccctcggacatgcccggcataccgagggatgtcgccgagcactcgctggatattcgggccggagcccgacccgtcaggcagcctctgcgccgattcgacgaggagaagcgcagagtgataggcgaggagatccacaagctaatggcagcagggttcatcaaagaggtattccatcccgaatggcttgccaaccctgtgcttgtgagaaagaaaggggggaaatggcggatgtgtgtagactacactggtctcaacaaagcatgtccgaaggttccctaccctctacctcgcatcgatcaaatcgtggattccactgctgggtgcgaaaccctgtccttcctcgatgcctactcagggtatcaccaaatccggatgaaagagtccgaccagctcgcgacttctttcatcacgcccttcggcatgtactgctatgtcaccatgccgttcggtttgaggaatgcgggcgcgacgtaccagcggtgcatgaaccatgtgttcggcgaacacatcggtcgcacagtcgaggcctacgtcgatgacatcgtagtcaagacaaggaaggcttccaacctcctctccgaccttgaagtgacattccggtgtctcaaggcaaaaggcgtcaagctcaatcccgaggagtgtgtcttcggggtgccccgaggcatgctcttggggttcatcgtctccgagcggggcatcgaagccaacccggagaagatcacagccatcaccaacatggggcccatcaaggacttaaaaggtgtacagagggtcatgggatgtctcgcggccctgagccagttcatctcacgcctcgacgaaagaggtctgcctctgtaccgcctgttaaggaaggccgagtgcttcacttggacccctgaggccgaggaagctctcggggacctgaaggcgctcctcaccaaggcgcctatcttggtacccccagctgatggagaagccctcttggtctacgttgccgcgaccactcaggtggttagcgccgcgattgtggtcgagaggcaagaagaggggcatgcattgcccattcagaggccagtttacttcgtcagcgaggtactgtccgaaaccaagatccgctacccacaagtacagaagctgctgtacgcagtgatcctgacgaggcggaagttgcgacactacttcgagtctcacccggtaactgtggtgtcatccttccccctgggggagatcatccagtgccgagaggcctcggacaggatcgcaaagtgggcggtggaaatcatgggcgagaccatctcgttcgcgcctcggaaggccatcaagtcccaggtattggcggacttcgtagccgaatgggtcgacacccagctgccgacggctccgatccaaccggagctctggaccatgtttttcgacgggtcgctgatgaagacgggagcctgcgcgggcctgctcttcatctcgcccctcgggaaacacctacgctacgtgctacgcctccatttcctggcatccaacaatgtggctgagtacgaagctctgatcaacggattgcgaatcgccatcgagctaggggtccgacgcctcgacgctcgcggtgactcgcagctcgtcatcgaccaagtcatgaagaactcccactgccgcgacccgaagatggaggcctactgcgatgaggttcggcgcctggaagacaagttctacgggctcgagcttaaccacatcgctcggcgctacaacgagactgcggacgagctggcaaaaatagcctcggggcgaacaacgattcccccggacgtcttctcccgggatctgcatcagccctccgtcaagatcaacgacacgcccgagcccgaggcaccctcggtccagcccgaggcgtcctcggttcagcccgtggtaccctcggctcccgagggcgaggcgctgcacatcgaggaggagcggagcggggccacgcctgatcgagattggcagaccccgtacctgcaatatctccgccaaggagagctgcccctcgaccgagccgaggctcggcagatagcgcgacgcgccaagtcgttcgtcctgctgggcgatgggaaggagctctaccaccgcagtccctcgggcatcctccagcgatgcatctccatcgccgaaggtcaggaactcctgcaagagatacactcgggggcttgcggccatcacgcagcgccccgagccctcgtcgggaatgctttccggcaaggcttctactggccaacggcggtggccgacgctactagaattgcccgcacctgcgaagggtgtcaattctatgcgaagcagacccacctgcccgctcaggctctgcagacaatacccatcacctggccctttgctgtgtggggtctggacctcgtcggccccttgcagaaggcgcccgggggctatacgcacctgctggtcgccatcgacaaattctccaagtggatcgaggtccgacccctgaacagcatcaggtccgagcaggcggtggcgttcttcaccaacatcatccatcgcttcggggtcccaaactccatcatcaccgacaacggcacccagttcaccggcagaaaattcttggatttttgcgaggatcaccacatccgggtggactgggccgccgtggctcatcccatgacgaatgggcaagtagagcgtgccaacggcatgattctacaagggctcaagcctcggatttacaacgacctcaacaagttcggcaagcgatggatgaaggaactcccctcggtggtctggagcctgaggacaacgccgagccgagccacgggtttcacgccattcttcctggtctacggggccgaggccgtcttgcccactgacctggaatacggctccccgaggacgagggcctacgacgatcaaagcaaccaagctagccgagaagactcgctggaccagctggaagaggctcgggacagggccttactacactcggcgcggtatcagcaatccctacgacgctaccacgcccgaggggtccgaccccgagacctccaggtgggcgacctggtgcttcggctgcggcaagacacccgagggaggcacaagctcatcccccctgggaggggccattcgtcatcgccaaagttctgaagcccgaaacgtacaagctggccaacagtcaaggcgaagtctacggcaacgcttggaacatccaacagctacgtcgcttctacccttacgatgtttccaagttgttcatacacctcgcacccacgcaaagtttagtcaacaaggaagggtcggcctcgcctcggcaaagcccgaccctccctcgggggctaaaaggggggaaaccccctctgcatcaaaattttcctcgaaaaaagatctcttttaccagaatatctttcgtgatttttgactacttcgaaaagtgggtcctggaaacgacggagtacacgtaagcagccaaggctgaccgagccgagggactcctacgcctccgggatacggatacctcactcatcaccttctgcgataagtaactcgcgttcggataaagtggctccgcggatcaaacaagtctttacgttcggaagcccttctgccgaagcgatccttcgagccttctcgaccgagttggtgacagggcctcatggacgggtgaaagtacgcgtaagcggcaaggccgaccgagccgagggactcccacgcctccgggatacggatacctcactcatcaccttccgcgagaagcaactctcgctcgcacaaacatccctgttaccgacaaaaagtccagatactcgaaacaagaggaaaagagacgcagctttacaacgcagcgagggtgtgtgttctggcctcggcggctgcacaaggcacacgctacaagacaatctgatcctgcaggctcgagtcttgacgctggaagggggcagcaacaccctcggcatcgatgacaccttcggcgaggcccgacctagcctcggacggcgacgcggtccgaggatctccgctccgaaggacgacgtcatcaccacgcccgggcaatcgctgccagggacttctccgggaatccggcccgagcaggcggctcggccggttacccctggggcctcgaccaaccatcttccaagggcgccagcccggtccgaggcctcggctgatcaactccggcattggtcccaccgacggacaacccggctaggcttcggccaaccaggtttcattttcgagccatctctgcctctgttcatactgatatcgctacccccggcctcggctcgtcgaagagcggccgaggggtttctttaactaagctagaggagcctcggacagcaaggccgaccgagccgagggactcctacgcctctgggatacggatacctcactcgtcaccttacacggggcgactcatgcttggtgaagcgattcagataatcaacagacgagtcttagcgctcaaaaatgaggaaaaaacacggctccgtgccgacgttacatacatgttcagggccccgaaagccgtaatgaacaaaaaaactgggattcgaagtgccattacaaacggaactccggttccccccctccgccggtacgaacaaaccccactccatgggggaaggcctgcggagcaacggaagaccgacaagacaacgcgcccgtgatccgttcctcgaacggctcgcgcacgcgcaacggctgccccgccaactactcaccccgtcgcattaattccgcggctggacaggcggcgtttctggcaggagcagcgggcgacgcttcgccttcgccgaaacaaccgcgccaaaaaaggtacgccgcgtcgttcggtttcgtatccttttccctttttcctcttttctctatctcttgcgacagggaccgggaaagggggataccccgaaagggatccttccccgtgaaggaaccaggctccgagcctccttactgatcagaggttcaaaggctggccccccgaagggtacaacagccgcctcagatcgcgtgggcccgacacccactactggtcagaggttcgaaggccggccccccgaagggttccacggccgcctcaggctactcgggctccgcgcccattactgatcaggggttcgaaggctggcccccggagggttcacagtcgcctcagacgccgagcgagggatgaccaggggtacgttcgatacataaccaaggctcgggctgcgctcccgaggtaccctaggacatttccgagaccagcgggagcgatcttgtaacggaatcccatcggagggaggcatcgagccctcagaccccgtcgccaggggaccgggtccggcagatcacccgcaggtacttttgggcgtgcctctgggcccctagccgacccccaacgaacgggacacggacgtccactcggattacccgcttgcagctcaccggagacaccatgttcggtgcccatcgagggtaacatggcgctctcccccctcctccttgcggaaaggcgacgtaggggcgtatgtaaaaaagccgagtctgtccctgatcgccctctcgctctgtgcagaggctcgggggctgctctcgcaaacccggctccagccgaaccgttgacagcgtcaacataccagcccgagaacttgggccccgaccgtgcacccgggctacggcctgctcgcatgagggaacaaccagaccagccgaagcattacgcaaggcattaagacctcgaaggagtgaaaccactcctccgaggcctcgggggctacacccggcgggtgcgctcgcgcacacccaccggaacaaaatgcaaccgagaaaggctggtccccttgcaaaaaagtgcgacgaaagcctccaagcgagtgctaacactcccttcgaggctcggaggctactgtcgggaaccataattaggggtaccctcaagacgcctaattctcagctggtaacccccatcagcataaagctgcagaggcctgatgtgtgcgattaagtcagggatcagtccatacgagcgactcgatcacgcctcgcccgagcctagcctcgggcaagggcagccgaccccgaggggtttccgtctcgcccgaggccccccctttttaacggcggacacatcttcggctcgcccgaggccttgcctttcactaagaagcagccctgactaaatcgcccgcgccgaccgaccgagtcgcaggagcattttaacgcaaaggtggcctgacaccctttatcctgacgcgcgccccccggcaaagccgaattgaccgcccgtcacttcgccgctccactgaccggttctgaacaaaaggacagcgccgcctgcgccactccaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttgtgttccaatagatggttggctgtgtacaacagcaacttataataagccaactccacaattatctttgatccacacactggcaagcgagagggatcagtaggatcaccaagtggagcttagcatgcacacacctatcctgatctgatcttctttggaaaaaaagagaatattcattcgtggtccacgtgaatgcatctttctggcactacgtgtttcgtctctggcctatacctactgaccaggatggattcggccttggtctctccacccctgtgcagcaaggcttgctacatgctggtcatggcttcttcttgggagtgtcgcgtggatatggcatccgatcccgtcctgagtttgattggcaaattggttcacttaaaactttgtatctacccacagataggatatacttcaatagttgaattgaccaccggtgatcatatgccaaaggaagagaaaatgacttgcccaatcggtacagctagcgagttttgattcttttcttcttcctcttcgtcttcctcttctttgagaattttctgtgattcctgttgccttttcctttttgcggatcatggagagttggttcccactagttatccatcacatgcttttagctttcggagtcatggtggaaggagtgcaggatgggaaaaaaaatatccttgagctgacattccttgatattgagctcgttttagacatgcacaatatgcaaagtcgaagatactaaacggtccaccaatttacgccccttggctgccacaaaatctaggccctgcattctgctccagtgaaaagagtgtcatttagaattttgcacagttaacatgttattaaaactttggttgtcgacatcctttttgaacaattgaactttgaaagacggcttctctagattcgccttggaaagtattatgaagacattaaaatctagctaaatttgctgagggacattctaaaaaggcgggtattgctggaaggcatatgattttgatgctgagttggttggctgaaggatgataaggtcaagatttgatggagaccaggtcttcttaacaaagcctatgtcttaacctcctccgtcttagcctcacttctgaaagagtgaaagtggggtaaagaaaacctagaggtagaacccatttgagactgtgaatcttcaatctcggtttgaatgagcaagccctcaaaaaggctagtctgagaggagtctagaactagaactagaaaccgggctaaaatgcacatgatccaagtaaggagaggaagcggagatctagatcttgaatcgagaaagtggcttttttttctatcagaaaatggatcaaagcggatatgcaaaagagttttggttgcaacagaacaaaacagacgcagatacagatgtacgggttggtgggcgccgacggggcccggggcctcgacggccgcagctgggacctcgtgggtggatgaggaggcgcatagcgcgttcgggtggtgggagcaatgggactgcgggagaggagcgggaggtggaggggggtgggcgaggtggcggcgcgccatggctcaacggctggtgcggatcggagcagacgagagtatgaatggagggagaggactgcgatgggccgatttagatgttcctttttttggaccagtacggatggacctatagtcgtttgatctggagcccattaccaggcacggtgggagattttgcccgtcggcaagcccacgtaaacctcatcttatattactgtaccagttttgttatttatttagcaaaagaaacggccctccgtaaccgtaataaaagtaacgctatccgtaatgactgaactagaaccatactaacagacaccggacagcatgatttggagcggattttagcaacgttcttctatttcacggcaggggaaaacataaaaaaaaacaagacgacgacatgtagataaaaacaagttgataacagtgataatcgatgcaaaacccactagaatgacattacgtcgctaatgacagtccaaaaaaaaagtatacgctacatcaaaaacaatctaaacggctggctagtttgattgcccgagacatgtgaccggatcaactgtaaagagttgtcgatgtcggtcgggttatataatatagtcagattataatctcaacgtaaacgtagatggtaggttcggtctccggtcaattatgtttatgaccaaccaacaaacaaacaaaaacaaacaaacaaaacggcacgcgtctcatcctcgtatcattagcgacacccaaaagcagtccgtgaagcactcctccaagctccagcagatgcggtggccggccaggatccgccgcacgccaaactgccaagagaaagaaagaaagaaagtagatagatagatatacccgacgggtggtcctttttttcccccggctttccccgtcctgctctgctctggcccacggcaaaagccgaggccgagagcgtccgcgaccgcgacacatgaaatcccgggccgggtcgaccgttgcagtccagagcagccaagcttcttgtttgctttgcttctgggtcctccttgtacgatcaggctcgcggccagaccgttgcaactacatacacacatcgcaaccgtgggtgggggcccacttgctgtctttaccttacccccgaccccgaccccgaccaccctgctacaacaacgctgctctcctacggcctgcagaggctctctccgcctgtgcacagagttaagagggtgggagggaggagtaacggagggagagaggaaggatagaagattcacggggtgcagtgcaggtgtggcactgcaggcctgggctgggcttgccgacgcccggctgttgtgtgccctaccctactgccctgccacctggcagggtacgggagtgtctcgtagcatggtttggtcagtggttatggttaggcaacaattgctacagcacagtaccttggatcgcgcagttactcccccactccgagtacgcaaacagtacctaaacctcttgcatttatggagcggggtacggggaggcgtttaaaaaggagcgtgttcggtgttcacgtgtgggcccactctccctagcccactataccaggactcctttttcctagggtaaataattagccgtgtgatcacaaaaatatgccaacgtaattttctccatgcatgcaaaaatatcgagcagcaaatccgtcccgaccgacgaggcaagcgagcacgcgtgtgttcttttttcccatcctcaatagcttcaagtaagtgaagataactcaactattcaagttaccttcactccacctaaaatagcaatatggtactaaaataaccaccgtaactgtgagtaggcctttggaatttatagaaatcactagttagatgcccgtgcattgcaatggaccaacgacatacaaaatattcaactaaatgttagtgcccttatggttagttgtatgtatgttcaatggtacatctaaaggagaagcatgaaaaaagcaggtgagagaatgaaataggaacaaatacaagtgcgccgtacaaaaagaatatagtatgtataacagacagatgcaaaatggtagcatatcccataattatcataaaaatactaaacacattggaatcccaagaaacacacaacgggtgtgttaaacgggatagtaaaacattagtattttattaacagacggatcaaattcaatcagtacatgcaccaaattggatcacaaatgaataaaaagtgaaacgacatacacacacaatcatctaaaaggtgaaatgagtcaatagctgttctagttttattcggtacatgcacgagcactgaagtaaacaacttgggatgaaaccctcaatgctacaacattatatcccatatgagctcaccaagggattagagtcaagattcagataacgggagaacaacagtaaactacaatcatatttattcaatcatataagaaaatagcaagtatggttataagaggaatgcaacaccatctatccaaaaaggcatactacaaatatcaacacagtcaaaatgaatgacttactgatgtatgtcctcaggattgcttcgaagtttttaggagcagatctacatttcatcaccaaccacttgttcccattttagcaagtaaaaaattccatggaagtaaaagcctaaccaattccttaccttttaaagatggacacattctggaacaacaattgcaacatgaaagatgacatgtgtctattaagcttgcctatgggcacctaggtacagggaagttgtcactaacacgacttcgatcaagattcaagaatgataattgggaatagccatgttgtatcatatgaagaacaaacagatatggacgacatgtttcacctgattagttgtagttttagtagttttaactgaaagcttttttgcctctttatccaaagctaaccactttagagaagcatgaggttaatggtcaacagaacacaccttcaactattctcgataaacataaacaaagcataatatacataccacccatctagacccttgtaaagcagcgccatctgcattcatcttctttacacaagtgcctcaaacgaaccaaaatcctcatcaatggcccagccaagtttcccatgaggcaacccctattatacgagtatacaacacgcaggggtgattaaatctgataactggaaatttgaaaagatagaaattaagaatacattatgcttttctaatcaatgcaagatcaatattttaggcacgcacgacatttattggtaaaggtttaaaggaacaatgcctcattattatcatggtctgttgcgtttttccttattgattcagcaactacgattagacagagaaataattatctcgtcactgtacttgaacaagcccattaatcaactacagttaatggttattttagacagagaaaactggaactatgcatagttccattttgctcgtatatgcatagttccattttgcatatatcaagcagtttgctccaagcatcgtggatgggacccttgtatatgtcaaatacttgagcaaaatccaaaaaatgtatcaaagatcaaggagatgtttaaaagcaaggatagttgaaccatgtattatgcacatataggtaatagtttgagttccccttgcggaagtcttgctctgacagcgagtcagctagttttgctccactgcacaaaaaaaacctcttctagtggactataacctacaattccaattccaacttgaatacctctcaccgacacctgtacaggttgggtgcgtcatgggcggaagaatgtccatcgaacacccacacatttcccacaacaaaccatacagcgaagaaacagtccagagccatcttgaagtgatcagcaaaagcttaggccctacaacgaggagaatgcagctcagagaaaacttgccaacaaagtatttatgattctgatgacatgtatagatatgctgctatcaaatgagaacagtaggacataaaacgttagattggttactgcaatgaattcttttaattatgccaagtgccaagcaattcccatttatttttttatctaacagatctgatctgagaagattagtcatactcatgcgccgagtccaggtattgtatggactattacttcttgagggcaacgatctgaatgcaagaaacacatctcgccagattaattctctttgcaatacaactcaggacaacgagaggcagagtgttcggggtgagtacctacgggctgggcgtcccgctgaaccaaaaagtatggcgacgaaggagcgcccgagatcctgggaaggtagctgcgcgaaggaggacatgggcgttgatggccgcctcgcagcgggtcacggtagcggatcgaaggcgcgagggggagctgagcgaagggggaggagggcattgatggcagcttcgtagcagatcacgggatctaggaggggagtagggcgttgatggcggcagcagatcacgacggacattaccgggtcgcgcagatccgcggcggagagggtttggcaaggccaggacgcgagcaacacgcgagtgagccatgacaaaaaccaatcgcggattggatccgagcagacacatcacgcatttagggtggtagaggcgtagtgtacactggagttgatgaactcctcgacgcggccgttggcaaagcggcccaggaggcgggggcccctggccgtggcgcgacatgcactcgaaggtgcggacctcgtcggcacggtcgaagaagacctcgacgccccggccgtagatgcgcacgagcaccttgcgcgggccgttgccctcggcctcgccgccgagccaggtgatccggaagacctcattggtcatggcgcccctgagctgggacacggccagcgcgccggggtccatgtcgccgccccagaggtccccggcgaggcggtgcaggatgcggcgcgcgtccaccggtatccggtcgatgctggcgctgcgcttcagcgtgggcacgaccttctcgcgcggtggcgggtccgcggcggccatcgacgcgtggaggggcgcgagtaggcgacggcgatctgcggaggcggagaagccgtgtgagtcgtgtgtcggtttgagtttgatttgatcggagagggaaatgcgattttggggggcttggaatgcggtctgtcactgtcggctgtcgcggaatcgaatctgattcttccgcggatggggagctgagtggaggagagcattggtggcggagaggatgtcggggtgaaggcagaaccgtgcaccatgtggtagatgtggacgcctacgttgtatgcttaagagtagtagagattatttagggaaagtccaaattctctaacacaaacatgcccgaataatagcgcctcctcctagtcctagctgctccttctgtaagtagagaggcactggttctaaaaaaaatacaacacttttaagacaccttacgcataaatatggagacttttacattaacgctgtcagtcacgtctaattttttagtacggtgtatacctcctcctctggacgcctgccacgtgcgcgcgcacgcagttaacccctcgtgccaatccagatcgatacaatgcaaaccaacctgatgaatgaatggggcgacctgtggagtagtagatttgtagtcagagcaatagattagtgtgctcgttgcgcttctatttattctacggtaatctattgtgccgtagtagtatagtataatatacctgtcggctgtcatcgttaagagctgagagtgtgtgtggttaggttaggattctccaccagcaaccattgcatgtgaagcttggagtgggcagagggcagtctgggcctcgctctagtggaaaggaaaggaaaggagagtgcaccactaataaattgtgtctctgtacatgtgtggtgtgggtgcgctcaacagctcaagcgtagtacaaggggcatgcatattcaatgcggttttgttttttaccatttctttttggtgcttttacttcatgagaaagccaagagaaaagtgtgtccaattaattcggcggaggggaggggggacagatcatgcaaaacagaagggtgttgtaccatgcatggttccttaactcctgctactattctagagatatgtgtctttttttgaggggtttggatggtgagaactgaggaattagaggctgaaataggctcacacaatatgtctgatgctgtggcggacctaggatttaaatctaagacacatttttttataattaacatcatatatagttaggtaccaagtatatttaatttttatcaaattaatatatgaacataaaacaagcaagatgcctcatgagtcaatgccatgtggggtccatggtatatatctaaagtttggatcttttaatggtatagattcaattgttccttcttaaaaactaggtagttttcataaactagtttcttaaaaacaaggtgtttccaaacagatcttacactttgaaaaaagaaacttaaccgtcccgttttctctgcactttctacggccacctgaacagatatacaccacactccctcaatcagacaatcacgtggtaattgcaccacaaactgcagtcgacgaacttaaatttccggaaacagtaaccgctgttgcttcttcacccaccgtttctagtgcatgcagcagaatgatacctgctggtcatggccacctggcttctcctcatcaacagctcatattttccttccttctccactacctccacccagccatcttcccccactccaccaggccaccaccaccaccagtccaccacctctctctctctctctcctccctttttctcccctctttctgatgctttgacgccacagctcgcagcagctttggccgccccgcctctgcctctgccgctctgcgtgcctcccaccacctcctctgccactggctaaaagccgagggcggagctgtaggagaagagccgaagagaagggagcagagagaagcgcaggagaggggaccgccgaccaccgagggagccgggcaagatgttcgacagtctgctcaactccaagttctacaacaaatggtacaggaatcctccctgccggttcggtttgtcgcgtggctgggatcttcaggcccggctgttctcgaatcctgccgcctgtttttttttctttctttctggacacccgagctcgaaatcgattgttttgagcttccttcgccggcgatctgttcagccttttctgtttgccctggagaaagggagggcgaatgtttgtttagccgcattccgctcgtccctcgatccgaatcctttagctccacttctcatctccttctgcgaattcaaggaactgttccccggacttgcgagcgttcctgctcctgttcttgatctgtgttctgctttcccgctgtttgtccagattcctgcattctcgatttgacctgtcacctgtatttgtttgatttctactaccccaaccgctgatttagttgctgtttggtgtagcaagcacgcgatcaagtgcacccggacccggctggatctgctgcggcggaagaagcaagcgatggtcaagttcctcaagaaggacgtcgctgacctcctcaccagcggccttgaatcgcacgccttcgcacgggtaaactgtcctcacttatcaaggcttaaacctgaattgtgcagtggcatcggaccggacggatctacgttggtttttcgaagctgaatcgcaccgaggaacctatgacgaaatgcaggagacatgtgatggtgtttgtaatggtatgttcctgatttctgttactttgctgtttaccctgaactgcagatggaagggctgatcattgagatgaaccaagcatcgtgctatgatacgatagaagagtactgcgaatatattgtgaagcagctcagccacatgcagaaagagaggtaactgtcggttcttcaagtgatgcactgttgtcttgtttggagatagttgcttcagtgcatagtttgatagctatataacatgattttcttgttcatttgtgctcaaggcatgccatactccagttctcatgcatatgtcacgtttaagattgaaaattttttcagtcaaggtagctaaccactgacgtgatgtttgactttctggtttagcaattcccatagtatcccaaagctgtacatgatttgtagattcttacgtgtaccaggtcctccttttttgtatttttcttactaaccatgcatactaccattgttctctcatcccaaaaaaatgaataccacagttgttcacatttaggctttgttcgtttcatccctaatccatggggattgagggggattttgacttgtaggggattcaatcgctctcaatccccctgggtttgataaaaacgaacagagccttagggatatgctagaatttcaatggtagataatatattttactttgggtgtttttacttgtatcactatcaaaatatctagttgttttatctatcatttcgattaatattacagtaagactttcttatgcaattggtcactgaatctgtgatgttcctttaacagtgaatgcccgcaagaagccttggaagctgtgtctactctaatatttgctgccgctagatttcctgatttgcctgaactgtgtgatctgagacatatattcacagagagatatgggagttctgtcgagccttttgttaattctgaggtgctgaaatgcttttgcttttcttatatttgagctgaactcaattggttggaacatatggattaacttaatttttctgtgcaacagtttgttcagaacctccagaataaatcatttactgatgaagagaagttgcgagtaatgaaacgtgttgctgaagaattctcagttccatttgatagcagggcactgcaatggaagataacttgtggctctcaaaataaacatgtaaggttttaataatctttttgcattatcagatatatgcaatggctcattgaataatcatttggtaagcatatatgcatcattcaatcctaatcttcacattcttttgccatcaggatcttccaaagaagagttcacttaaacatgatatggaacgagatggacacaaggttgataggcatgctgttcatgaaagaaaatcaaaagctatgcctgaaggctatgaacagaagcaggaaatgaacgtaaaacccaaagatatccatgtcgttcctgatggcattggccagttaggtgaaaaaaacagaaagaactactctgataaacctagtgagagaaggcacgtggataatcctttgcctcctttggacatgaaagaaaagaatggtcagaaagaaatgaagaaatctggcaaaaaggatagtgaccgtcggagggaactgatggatgtggaggtgttagacatcaatggcttgaaaaaacaggatgttggtgcgatgaaaccttccggtggccccgatcgtagttggggtcatgctgacctggggcttaaaactctgggcatagaaaaacaagaaattgatccaatttccaccttgaatggtaaagcagtgaacaagcctcctccttattctaagccctacagagcaccaatgggcgagaaggttgctgaagacaggcagcctgtgccagagaaggcaaccaatatgcgtcctccttatgttaagccaaattttgaaaaacatgcaaatcaaggcgcaaatggccacaagcagagtggcaccgaagaaacaatttaccagaagcgtgaaccaatctatgatcctgtctccgtgagaagtagggttccaagaccacctgcacatgctgatgaatatgctggaatggaggaaaagatggcaaaccaagcacctgatggccgaagaagacactcaagcaagaggaatggtgcccatgacaatcatgaccagagagttgcccatgttgtaccacccttagaaggcatgggggtcgatgacgatatcaacaacgcgaggccttttcatcgagttcctagcgagcgaagaaagcacaaaagcaggcagaacggatcgacgagcggcagtgactacaattgggccagcgaaggccacgagtctgatggcgacgatgtgaacacatcgatcgatttcggcaacctcctgccccgagcccccagttcgcacaggaaacacaggagccggagcgctgatcctcgcaaggcaggaggccgcggcgacgacgaggagaggatgatggacaagcttctgatgcactacagcaagaaagggctggacagggaggagcgcaaggagagagccaacaagtcccggaccctgttcccacgagacgaccagcgcggcgacggagccggagaactgtctagcaaaggaggaggagcatctgcacaccgccctgaaagagccgcatccttgccttcagaatccgcaagccccaaggcaaaggcgaaggcgaagccccctgctcggtccatgtccatgcagccagagatgtcgagggggaacgtgcatccgagcatgccggatttcgacgaactcgccgcgcgcatcagtgctctgaggaacgcgtgagctgtgccccaagactgactgcccttcagcgacgcttctgttgtttcaggaacaaacctctaccatggaatctgaaacctggtggtgcctgcgagtcacggcctcacgggggataagaggacactcgaggagatacaactgtggcctgttttcgcagcaatttttttttgtcttggtggtatacttgttctcgtgttgctctgagtgtgtcttggtggtagagtattgtcatcaggaagagttgttaagatgtggcaattcatagggataccatactaccataccgatagccagctacagcgatctggatgtggttgtttgttgtactcatagaacagatactgttggtgtgtaagatgtccattgatgctgctacgatgataaagaaattccttcttttattataagttttccctccatttgctgatgaggccggagcaaatgccgttttcttcagcgaaaatcaggcagcctggcggcaggcattgcttgctggttccttgttttttttttagtctctcctgggagaggagaagggcatgtgacggttgttgcatctggcggtgccgaccgacagcttctgctgcaaaatcattcgggggcacgttcttgcattgtgcggtattcttctttcttggattgcccaatcgatctttttttatatatgtacggggggatcgggttcttcgaatcaattttatatatgtactaggtcatagtttcaaccgaaacaactgctagtcttgttccaatattgttatagatagatgaaagaaatcgtgaagtgcttttttttgggggtgtcatttgtacctttgattcagaccattgacactgaggccaaactggtagctaggtcatactagtttgccaatcaaaagagagagagaaaaaaaaagaacggagggcaaagtcagcactccagcggtcagcagcgcatgtcttgaagaactctggccgtgcagccgtgcaggtgcagtgcaggtgtggctgacggctagcccaaggacctcatgacgccgacgacgaaacgcaggatgtcgcagtcgccttcgccgccgccgccgccgtcgagcacgtcgtcgcagaccaggcgctccagcgcggggtcccgcggcagcgccccggcgtggaacagtacggtcgccgccgtctcgggcagcggccgggctcgccaggcacgcagccagcctcgcgacagcccggaggaacagcggcaggaggccctgcgtgcacgcaacagcgccgacgaccgcgttagcagactagcttagctagctagctagctaggcacgaaatgcagcgagaaaccacgtgacgacgtgctcaccatgcgaggttctgtggacgacggctacggtgcatgtgcggcctgaagcgttagctctcgtcgccggtgcttacttgtacattatatacatctataaattagtaggtagcatcggaaccatctactgggaggcggaggccgcaaacggggcggcggtggcaacgacgggcgcccattgtcgcgtcgcgttgggaaccggcagctgcttgttttgttcgcctcgttggtcgtcgtcatcgccgtcggtcgtgcagtgcttttctccggctctcggttttggactctgctgcgcctgcgcgtcctcctccctcgttcttcgcctgagcgagcgtggctgcctttttctagtcggggtcgcaaaggccccccatgctgacagggttatttatttatttatttgaatccatgccattataattttctagattttaaaatacgatagtttgcctatttagaaatctatcattgtatctttatctctcctttatttacactagtaccattttctgcctggatgagccaactgtcagcagcggacacgtacagggatgtgcgtgcgtgtttatattgtaataattgaagtgattgataaggcaatttgcatggatatggatgatgatgctgaatgtgatgcactggactggagcctctctgtgtggttgcttcctcctgatgcagagttaggcagatgctaacatgacaataaagccaactagtgctggagttgacactgctggtccatctaatacgtgctggcacctaagaagaccaaggcacctaagaaagaacaaggctaaagtggttagaagaagcctcaaggatttgctgtcttaagggcagtatgtaaacttgtttagggggtgatatattaagtgtctgatggctggtcattttggtaagttcagttggtggcctgttaaactgttgtgtagcctgccctttttcgtgcctataagttaagttggtggcctgtgatggagtagtaatggcctgtgagctttgttggcatttctgatcttgtagactgtgaactccaataatttaatttcgctttggttggggcgcgcctggctcagcctgtagtgcaacggccgagcgacgctcgaagaacccagtggcaagccactgttgtggtccctccccacaaaaaatacatttaatatcgaagtgaacacatggtccacatatcagatattaaactgataagaacagatactacacttgatcttagccaaaaggccgagaaaggtatgaattgtgacggtgccctgcaccttcttttgtagtctgcttcggttgcctcacccaccaagggctgccgagctggtactatcctatgaaaccggaagcggaagcggggcggagcgttgtggctcggcgcctcggctgcccggacgttttctcccggcccgttacgaaggttgcagcgcacgctgttcgcgcagcccagcccagcaattggccttatggactaggacgacaaggacatgctctttggctttgctcttgcttctgtccgaagagaagtaacacagctggcatgtggggcgggcgttcatcaacaggttaaaatcatgaaccgaggaagccacgaccctaataataaaaggctagactaaaagctcgggttactggcctgacttcgtcttaacgatggttcgtaatcgtaagctcttagctacttgcttgacctgtaagactttatagcattttattgcatcgccgtcacactactttttcaagctaagttaagacttcttgctttaggcatgcacatcttgatatcctggtgttggaagacgagtgcataagccacagcttcttctggttctaggtcatccaattgattttcaaaaacagatattctgttgattttgacactcctcaccacaattcatttcacgtgatactctatgcttaattcagcatcaacgttgcggattgcctattcgcctttagtacatcaatctgcagaaaaaaaaaagagaaggaaataggtgttagcaaagtacttgaaaattctgacaataaccattaaatgtttaaacaaataaagaaaatggattgacaacacagatatagctccctcgtcctttatggattgggtggatacaactcattgacatattaaagcccagcattcagaacccatgtccaaaccgttgtcctggtacagtagagttggaaccagaaacaacgcccatgtatatcccaccaaatcaagaaacaaaaatattattatttttgaccatgtacgcatcaagaaacgacaatattattcttccgccaaaagatttaaagttcccttattaattaagtaatacaatcaatttttgaattggtattggttggggtgcgcctcgtccagccaatagtgcaacggccggacgacgcttgaggaacccagtggcaagccactgttgtgattcctctcccacaaaaaataaatttaatatcaaagtggacacatggtccacatatcagatattaaactaataagaacagatactacacttgatcttagccaaaaggccgagaaaggtatgagttggaacgatgccctgcgccttcttttgtagcctgcttctattgcctcgtcttctttcagcgagcgagttggtgctatctgcggggtaccgtaagcggcgtggagctgcgcagcgcagcgctgtggctcggccgtccggtaagatgttttcgcgcggcccgttacgaaggttgcagcccacgctgctcgtgcggcccgtcgccctgtgcactagcacatacacagctgacatgtggtcctttcgtttatcgagaggtaatcaccaaccaatgaagggacgaacgaatcaagctgaatctcagaattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgatgaatcagcttgattcgttggcagaaatgtaataatatttacatccatacctgggcgttctggagaagcctcgtagtcgaccaggtcttctcccagcagatcgtcctcttccattgatgttgtcgtgtcgttggaggcttcctggtgaacggcggacggtccgcgtgcgggggccggacggtccgcgcctggtgcaggtcgtccagagacttcctggtgaacggcggacggtccgtgcgcaggggccggacggtccgcgcctggtgcagattgactttctatttctgtggccgtttgttttttctcaacggccttcggtctccatttcttttgcggtggcgggtatagtggatgtgtgtcattaaatgtcttttccgcctccttctcctggctctcctttgctcttaggcgctgtaattttctcttttgggatcgtgtcaatcccgctgggcaccatcgaggcatggagtattttggatcgactgttttgatggtagccgtatccttttcggttgtgttggccgattcgccgaaaatcatcggccctttattatcttcttgtatgacaacatctgcagtgcctattttgatgatgtccttttttgttgcaggcatatgcccccctgccggattggtcggcctaggaggccgagtagtccggcaatcttgttgggtctgtgcctggtgaccagattcagcagcgctcaatcggtcttgcactggcggcgccaacctatcaaaaacggatgtttggggtgccccccaggcggggtactgtggcatcccaaatggatatggtggcatgccccacatttgatttgggacatatggtggaggtaagtatgtgtatggatatggcatagatggataagggggtggaggggtccatgtcggcatgttaggtctcaattgtacaataggacctttcatttcttccgattggtgaagtggtccaatcggcctgacctgacgttgctcatgaatgggcgagcggggtcgcttcggtggccggtcactggggccggccttctttttcacatatttagacaacaattgatcgaaagtcgggccaggcttgatcagccgaccagctgctttaaatgtatttgttttccacgtacctatctctggtcgtcgtggtttgaaggtacgtggtcgctgcgagtcctgagcatggccggaccgtccgccagagtcgtccggaccgtccggggaagcgtcggaccgtccgcgtcgggacggcagactgtccgtgatgcgcagcacgggttcccgcaactgtctccctgtctgcgcttgccccccagtgttagaggctgtgatggtcaccttcagtgtctcccctccatcgggagtcttctcggccaccaccttcctgcaagcaactttacaatctccatcggcccttttagcattgccgatgattgtttccttgcctttgcctttatcggctgtatttggccgaaccaagactttcttgccctcgaagtcaatcatgttcatcggaaagggctctgtatccacctgcatttcctgaaatttcaatcgtccttcgttaatggccgattgaatctgtcgccgaaatacattgcaatcattagtggcatgagaaaatgagttatgccacttgcagtacgcacgacgttttagctcgtcggcggatggaacagtgtgatttattttaatattgccatttttaagtaactcatcaaatattttatcacatttaccaacattaaatgtaaactttacctcctcttgccgtttcttttgaaccggctgtaaggaagcacaagccgaagatttggactgctttggccaaaccatttcagcagcgtacacttctgctgattcgtcatctgagctactttggtcgcattctactatgtgtacgttgtgacgcattgttttagcagtttctttgctccggctttcgcaagccaaagctctctggtgtaactgtgctagtgtaaaaaattggatgccttctaatctttcttttaaataatatcgcagaccattaaaggctaatcctactagctgtttctctgctaaatgaatttgaaagcatcggtttcttgtatctcggaatctccggatgtaatcattaaccgattcatcttttgtctgtcgcaacgacgctaaatctaccaaatccaactcatagtcaccggagaaaaaatgatcatgaaatttttgttctaaatcccccatgatgaaatggaattaggaggtaaagtggcgtaccatgcaaacgcagttcctgttaaagataatgaaaataaacgtacgcgaaatgcctctgtgtcggccaactctcctaattgtgctaaaaattggcctatgtgttcacgtgtgttctttccttgatcacccgaaaattttgtgaattcgggtatcctggttccctgtgggtatgggtggtgatcaaatcggctgtcataaggtttccgatatgattgccccccagggaccatgcttactccgagcttatctcggaacgccccggctatttcttccctcactatatcaatggcagccggtgcaagaccaccggctctctggttaaacataggtggagttggttgtatattagtatgttgtcgttccccccattggtatgagctacgtggtgcatttccatttgccctatatggctcataggtttgatcgtttctttccggccttctaggtgaggccgagaagctttcctgggctctgaatcctgaattaatgggctggtgcattgcatagtgtgatgggaagtgttgctggggcgggcgaggattcaggtaataatcctcctcaaaagactcatgtgcggactgtctggtcattggcccggaccgtccgtgattatgtgcggcccgtccgtcgttgcatgcggacggtccgcctgggtagtttagattcagtgttgtgtgtggtggttcgggcgcatatctaggtaactcattaaaaataggccccactgttgctggcccggacggtccgcgctcacgtgcggacggtccgggcatgtgcagatcggctggtttgctgccgatttgcggttgattagggtatgtgtccatcggcatcccataaaggggttgtgactggtcgtgacaacctgtagccgatgtgttacacgcattatctcctaactcaacctcgtgcgaaggaaaatttgcggtactagatttatcaaatgcacgtactagtctcttaagatcgctttgcataccccctatgatgttatgcatttgttcacgctgatcttctacataatttctaagagattgcagatcgttggtattacttacattggggatatctggcgtgggttggagcgaagccggatccgtcgcccgatgtcggacgaccttgttgttcctgtccactttgaagttggccaagaactttgctttcgcctcctggatcatccgctccttatgctcctcgaactggagctgctcgtcagccggcaaggtttcccaagtcggctctatgatgttgcttggagaaatatcagagctatcccttgaaccggccattgagggccgatttgatgagcttagatatgttttccccagcggagtcgccaaaaagtatgttgacgcctttttggagcgccaaacactcaacaagaaccgtggcggtgccttctgcacaggggcggacggtccgcgcgcaggggccggacggtccgcggcctggtgcgaggcgcggtggtgctctctgcgcaagggcggactgtccgcggcctggggccggacggtccgcggcctggtgcgcggctagggctcctgcctgacggccggacggtccgcgccctgggaccggacggtccgcgcgtacgcagggacggcggaagatcgccgatggcgcctggatctcgctcccgggagggaccccgtcggggagtagagatcctaggtggtgtctaggctcgggtagaccgacctagactcctctaatcgacgtagagtcgaggagaggcggagaatttgaggattgagaggctaaacctaaactagactagaactactcctatgataaaatgcgaataaaagttgtattgattcgattgttgatgattacaaatcggccgtagacctctctatttatagaggaggggggctggaccctttacacaactgattccgagctaatcccgcgaatatagctaacaaccgtagcacaaaactcggaaccctaatctgttctgcgcacgcgcggaccgtccggcccacaggcgcggaccgtccggaccgcggaccgtccggcctcagggccggaccgtccgcatgctcacttttggttcgaacagtactgttttcactttaaaagctaagtaatatagaagatctttgagattatgtatatagtttttaaaaattgaacatgtatccattataaagtgaaatcattacgttagaaataataacaggatataagtcgtgcataatcatgtcagccacttgatcgtgacgtgatcgtgctagcccatcatgtcgggatggtgtccgtgtttgtgacccgaccatgcaccatgggttgctcacgtgatgcttttgggtaggacaacatcgttgatcgcgactcaatggttcgtgcataagcacgttggggttactcacagagttgtacatgttcggtccgcttagaaatggcgtaataccttacttcatgttggagatttggtattgatctctagagtatgaggattacagacagaagattgtgggtgaggatgagttggagtggtggatgatgagatatgaaatggtagggggggcctcgggcttatatacatgaccagagagagttatcccattataagctgcgattactatctacttgcttatctcctcctttgtcgcagatcgtgtccctgcatattcagagccttcatctcctaacctcccgagttatcgtcgaatgccaagcccttcgggtgtttgcaactgcatcatccgacacctccagtcttcaatggcgcttaactcgtacgtcggtcttcattagcctgggtcgggctcacctgagttggctcccttagggtgacttagcaggaagcccatcaagcgtcccaggatatgttttagtgcatgtgaggccccaggggttattgttgggaacctgcctgcctgggcaagttgatccaacgagtgagtgggaagcgtgtttgtaaagtttagcatgtgatgcaaaaagcttcgttaatctctcttgtgagggcactgtacgggggtatttataggtactcgaggggccgcctgtccgtgtcaaagacgtttagaccctcgatatggctgggcattcggtttctttctaaacttcggttcggttttttcggttttacagacattagaaaccgatcgttttttaagaatgaaaaccaagaagtttggtttcggttttttacttcagtttttcggtaaaaaccgaataccaaacttatactcaagacagtacatacaacaagttttcatgatagattacacataatttttaaaaaataaaaattttataggtacaaatatttagagatacaacatacatcccatacaaataagtgaataacaatttaattgtatcacatgtttagttcacataatcgaatagtcaaatttgataactgataaagtttggtattcagtttttttggtatttcggttcggtatacgttgaaaaccgattacgataccgaaatcgaatttcttagataaaaaaaccgaaaccgaactgaactaccgaaaaaccgaaaattcggtacgattcgactttcggtttatggtaaaaaagtgctcacccctaaccctcgagtacccggtttatccctagaatattcccacgagggaatgttgcagatagtcattaatgtaaaccttattacagacacgacccttatcgcacatgtcctcacggggcccatcactatgggccgaaatcacacatgggcatcccccgacggtgagggcacgtgaggtccgtagacatcggcagggccttcatcttgccacacgagagcgaagggggtcgcgcaggtctccgtccgatcgacgccctcgtcttgttctgccatgttttgtggatgtagccttcgcctgcgcaatgaggagaggaagtcgtagagcgaagggtggcgtgttcgtcttcgccccaacaattatctatcccccacaggtgccggtccaagcacaacactagagtcataccgtacagaagcactatgagtcgcgtcatgcttatgctatcttcaacaacttattcatcctcatatttatattcaaactttactttgcgagcagtaaaatatacaatataaaaacaatatttttggtccacaatttaaggggtgtttgtttgagattataatctatccagattatataatctaacaacttttaaactaagagttagttcaaaaattgttggattatataatctaggtggattataatcccaaacaaacacccccttagtctattcctttcgcacaaaaaacacctccatgcatgcatgcacctccacccataaatggcttcctattccgactctgatgctgcaacaactagctcgttgctctcccctccctcgaaaatcgtcacgtcgcaccacgcaccggcgctacgaaatctcgatgcgatccgaggatacaagaaccgacctgcgactacgccgccgtgctccgtgcccttgccgcgcgcgtttgcatgtattctcttgtctagaacaccggcggccatggcgctatcggcgttgccaacgtctgcgctgagctccctcgaggcgatgctccactccctgatgcgagggtcagggtcacgaggaggaggagcgggggccgacgacgatgacgacacgcccgtccacgacgacactctctcctcctcgccgccgccgccgccacttccatcgcgtccgactccgcgcggccggcgcccttcgcggtcgcggcgcagagtccgggtccaagacacatggccagcacgggcgcccccgccaccattgtcacctgtcgaggttccgtcctacgattcacttctccgcttcccctatcgcatcaaacattgttaagcattgggcatcatcaatggcaatttttgaggaacacgtgtggctgctcgaggcttattacaatgcgttatgaccgatggcgcaggaagacgtgacgacagcggcgacggagggtgtcgtctcgccctcggtgtcggtggtggaggagctggggagaaaggcggcggaggccgaggcgcggctgcgggagaaggaggaggagaacgctgcgctgaagcggcagatcgagagctaccatgtcaggtggctggagcacgagatcagggccaaggccctggaggaggcattccacgaacaggtggccgctcttcaggtccgtccgtgcgtccggcagagtctcgattctcgaacacgctctggatcgataacataactagcgtcgatcgatgctattcatgaccatgcatgcaaaatggctcaggacgatgcgcggatggcccaaggaacagcgcacgaccgccgcggggccgggtcgtcggaagagacggcggccgaggaggatccgccgccggtgaggctgtggcacggccgggaccgcatgtcctcgtccgcgggtgccatgcggggtgcggtgggccgcctgctcgtcgtcgcggagttccggcggcaaagccgcacgctggagcacgccgcggagccgccgccgccgtggcagccggccgccccggtcgccaactccgccgccgacctcaagaagctcaaggcgcagctccgcgcgtgggccaaggactacaaggcccggctgcgcagggcccaggccgggatcggcagggatcgatggcgcaggggcaactgctggatccgaacgagcacttagaacatgcatatgcgcacaattcttcttggggtctccctggtgtgggaattccttttttttccgtgctcccatgaacgaattttgtaaaagtagatcacatttggggttgttcggttacaccaatccatatagattgaggaagattgatggagtttcaatttctagtaagtcaaaaaattctcctaatctataccaattttctataatccatatggattgaaaataaccaaacaaacccataggtggagtagaaaaaacaattgacacgttaatttgcagatgccaaacattgaagtttgaacgcagatcgagctaaacaccagcacatgatgataggttaggcttagacttgaggtgataagaatcgttgtaagagagcactctaagagcaactccaagaaggaatcctaaactgaggccttaaattctgttttaaagacgaatttgatatgtttaggatctgaataaattgttgctttccaacaaacagaccctaaacccagtgtttagcaactaactctgattttcgcggttcccgctcacgcgttactctgtttcccgctcgcgtcacgcgcccaggtttcttcttattccagacggctgcacacacgatacatcccacagcgccgtcaacctccccagcacagggcaccacagatctcctcgccttggatcacctccgcgcatccatattctggtcagcggccctctatctccctccatcctgtattccatttgcattgtttctgcaaaagtcaggtcctgcaatctcctgtgcatttgttccccacggaagagataataaagtgccaaagattctttgattatgttgcttctaatcaaaccattgacgttgtagcccatatgttcttgccagtattgttccatgagttgtatcttgtatgaataatttattcagaacctgttgtacaattgcaactagtatgtagcatgttgatcaacttcattttgcagtgtatatcgtcatatgttgtgatatgtgacagcttatatttagtaaatgggtaactgaaataattttatattctgccatatgtccactgcagaaagatgtctgcaactacgatatctatgatccaccgcgaagatgaacaatcatacaatgaacttgaccacttcatgcttttcttgatgggtgcatatcggaagaggaagcaaaagcagcgaaaaagacatcgaggttcagtttttggacacaaggtttacaatcgaagtagagatgaacacggtatgaaattgtaccgtgactacttttgtgagaacccaacatatcctgagaagatgttccggcgccgttttcgtatgagttcatctcttttcaaacggatagctaaagccgttgaacaacatgataactattttgttcagaaaagaaatggtgctggtcttcttggattttcctgtgtacagaaggtcactgcagcttatagacagttagcttatggtgttccagctgattatgttgatgagtatttgcggattggtgaaagcaccgctattgagagcctacggaaatttgtgagagcaatttgcgaggtgtttggcgaagaataccttagagctccaaatgaagatgatacaactagattgcttaaaattggtgaatgtcgtggatttcctggcatgcttggcagtattgattgtatgcactggaagtggaaaaattgtcctactgctcatcatggtatgtattgtggtcatgtgaaagaaccaaccatcatactagaggcagttgcgtctacggatttatggatatggcatgccttctttggcctaccaggatcgcacaacgatattaatgtcttgcgcagatctcctctctttgacagacttatggaaggtcaagcgccatatgttcagtatatggttaacaggcataattatgaaatgggttactatctagctgatgggatttatccaacttgggcatcatttgtgaaaacaataaaggcaccggcaaatttaatggataaaaattttgctgctgctcaagaatctcagagaaaagatgttgagcgtgcatttggtgtgttgcaggctcgttttgcaatcgttcgaaatccagcgcgattttgggatgaaaaaacactccgagacattatgttggcttgcataataatgcacaatatgataattgaagatgaacgagacgctgacggtcttgatgtgccttatgataagagtaatgcagagactgaaggtgtggtgtcgcgtgtagggacttgtaatttttcgccatttgttggacgtcaagaaattcaagattctcacatgcatcgtcaacttcagcaagatctagttcaacaccgatgggagtggcgcgggcaccgaaatgagcaacattagtttaggcagacaatgctatttgatgaataaatcattagtaaaacagtatttttatttttccctttctcaacatgtctgtaatttttttagttcaatacagttgtttacatggtcaacatttcttgctgtaagttcaatacagatgtttcagatcttcaaaaatagagaaacaaggctcacatggttttggctgcaggaaggcagcagagacaagtgctgtcaacaatccagtaactaaatcgtaaactgaatcatgctgccattacacaaacaggaataaaactgaatcatgcttcatacagtttaaactactgatctgctcaaataatactcattaagcagtactgaacttgaaggcagcagcctgaacgacagaagaaaactgaatcatgctgccattatttgactgaataatgatcctgaactaaaggttttatttgactgaataatgaagcctgaacgacagcagcctcaactaaaggtttttatttgactgaataatgatcctgaactaaaggtttttatttgactgaataatgaagcctgaacgacagcagcctgaactaaatgtttttatttgactgaataatgaagcactgttgcctaactactcccgaaacgccgagccaaaatctcttgtttcatcatcttgaagtatagtttagagtcatcgtccattgtgcttgtgtctgttagcataatttctttgtcctgccgattttgctccaattgaaccttggtcatctcaagctcatagaacttatcatcacgggccttccggtctttctctgattcttcccttgcttccctcatctttttaacttcttcaaagaaaaaatcgccatcagcatcgcagccatcgtgctttctcgctcgtgctttttccttctctgctttcctccctagtggtctgtcagcattgacaggaccattacagtttgcctcatggaggtctttcagctttgaatctctgaaagtccactttggctcatgcctaagaataatccacgcatggaagacagaaaatgccttcccttgatggtcttcccgaaatttcgctttcgcttcagcaagctacaaaatgacaaggataaatcatgtgagcaaatgctgttatgtgaagaaattgttgtataaacatatgtaaatttcaccttgtcatcactagtttttccactttcattttttctttctatggcgtcatagtattgttgaaaaatgttcacttccttctgaattataccccaacgatgcttcaaagacgaccaattacgatccgactcaaatgtcctattcttgtgaaagtatttgcatactctttcccaaaatgtgccatctttttgatctcttccagtaataggatctttactcacattaagatacgctgaaactaatagtgtgtcctcctcttcactgaaatttttggatcggcaccttttagtcacttgtgagctcatttcatgcagcaccggtgattgtacagcttcgttatcaactagcacataatcatctgagacaaaatcatctgcaacatcctggcttagtagtgacgtgtagtaaccaccatgggaattcagtgtgctgcaagaataaaatagttactacaacctaaaagtattattgacacaaacaccagcaaagcatttaacaatacatgaacattagcaggtgaacaatacatgaaggaaatcaattgaaagaagttcatggcattcaaacctagaatcggatgccatccaagagggatcagcgttgttgaacaatgagtgtgatccaaatgaaggttgttggcgttcagtcggcatcgaagatgagttatcgttgccgaactgtgaccgagatgcaggttgagggcatgcagcgacaccggatgacatgggacctgttgattcttgccgaattgcatttatggcggtgtttagcgaggaccttcgacgacccctttgtggctgttgcgccttcctttgatccatgtgttgagttcgagatcgctggagcagggaacgccgactggttgcagcagggcacggcgacgagatgccaatcctgtgcgggcggggctctggctgaagaagacgggagggatcaggttgtgcgtctccgactgcaagctgggcggacgggcggggcagcacctgtgcgccggcggctgcggatcacagttgccgatggcccatcgacgaaggagacgaagattcacggagggtttggcggttgagatagcaggataggacctcccgtatggggttgtatatctaggactctagggttggagtcctatataaatttgcttcaaatttataaattaggacctttcttggaagctatttcgtagtcctaaactcttttatttaaaataagacccggtttagtatctttgttggagttgctctaacaagtcactacaacgattcttactagaataaaaagcgccctatcgggcgctaaggcactaagccaatcacgtacgtagtgaaacaaataaaatcatatgttatttgtttcatgacaaactctttaatgcggttttaaaagagaatctacatctagatcattaaatgaaataggatcaaatgctttctgaatctaacatttttttcagaaatcaaagactggtacaatttctcagtaacatacgttcgaccactggcgtacagggaaaaagaacggcctggatggccacatacattgctgggcagtcgaagatagtatttcaatccggtcatgtacatataactatacgaggtaaaggcagtacatacccagtttgtcccctccagctgagaataaaaagaggtagcaatgtatccacaattcctgaagtgagtgcatagatgacaaccaatgcagtaaatagtgcaccatggttgtaagggtagaatactccgacaagtgcaagaaggaatataaaggttgtgttgaagaggtgccacagaaaagattgttaggtatcttttttgtcgaaacaatgagctggaggaataatttcagccctgcaaaatattacagacagagagaaaataaccacaggaacctacaatgccaatagttgagttcctgtaccaagaacagaagaaaatactgacttattctttgggaatcggaagacgtcaccatgagggcttgttcgttttgctctcgatccatgtggattgggtgggactgagtgggtttaaatcccaaacaagttaaaatctttcataatttttttcaatcccatccaatctacatgggataggaataaccgaacaaggcatgaatatactttccatccagactcttcctggtcatcatccgcttcctcatcgcgggcataccttcagggcttgttcggttctaccccaatccatatggattgagggggattgagggggtttcaatccccagtaagtcaaaatcccctccaatccatatcaatcccctccgatccatatggattgaaaataaccgaacaaggcctcaagtggaaatgtacaatctaaagtaaacatacagatgtacatacaactgaattgtatcaggctaagttgctaacacgttgtgtgcactgtacctgagataatcagccaatgtgatcagctgaatgtataatcaaaatttatctttgaatgtgttaaactgggctgtatatatgcatttatctctaaatgtgataaactgtatcatatatatgagttttctcctaatctgaacaatcagtgaggtccaattctttttttgtatagatttccattttcttttacattcccctgcaccgtgtacaaacaaatatggtactgagcctaaaaaacctacgaacatagctctattcatcaccattttgatatcacgtataacatttgtagatggccaagcgatagttggatttatttcaattggtgtcattctacaacagacatgccaagaggtaggaaaaagcagaccattcaaagcaatgagtaatatttgctagaggagcatatggaccaagaaagtcatgaagaacatgttgtattacactattacctgactgttatcctagtactggaaaagtccatctacatagcaacaatgtcagtgagttcaatggccaaggtatttgccaagctcgctgatacaacaaataattactctatcaatttaagatcatctatgttttaatagtgcatcaacatcatgtcagtagctactatggttcacaaaaaagcagaagcagagctaatgcagcctgcatggcattacagatatggaggtgctttcataacgtgtcatttttagctgtacagacataattgcacaagcaaagcatccaaattatgttctatccttgatccaaacaatgcaagcaaaaacatggaatcgtcacacagtaaggaaggctgtaccggctctctcgtcttttctggcgaggaagccctcgcccctcgcctctggcgacgtgcagcatgacccagctggcgaacgagctgccttgctggaggctttcttggcttcctgctgcgatcaaatcaacacattagaggtgagcggaagaaagcaacgacagcaagaagaggaatcaatttggtttatctatcgtgctgtcaactatctgctatctgcaacttttagataaatttaagataggtttggatggcgctgagtgaggacgtgttcgatctagtcggtgagcgacggatggcaacgacaactgaggtgacggggaaagtagttcagaaacagtatcatctcccagagcaaacatggatcactctaacttgtagctggagctcagtttgaaagagaattgttcagaactatgctttgtattgatggaggtttggatgttgagatattccagcccctctccaagtccaatatctaccaaaaaacgaaagaaaagtcagttaatagtttactgaatcggacggcagcaactgaaaacaaacatatgtcaaccacctcctggctcctgctaggagctaccaggtatgtactgctctcttgcttccccaagttcccctcatgtccactcatccccatgttcacccatcctgactcttcgagtagccatgtcaatgcagttttttgcttcaaaaatcgatctgctcatgctcgtccccacccagctagttcacaagcctcaacgaagctaaccaaacatcaagaataaggatgtacacacgtataatcgaatacaagcaacagaacatgagtattacagattgaagaagaggtgtgttgccgtcgacgatagccccgcgatggtggctggttgagtggacccacgatgagtcgcaccagatttactacgggcaccaccggatccatcgcggggatggacaggacggtcgaaatgccgcgcggacccagaccacgcgcagcgtgccaagccccgcggccgggctcgcgcgccacgagtcccgcaaccgagtgccaccgccccgtgcacggtgcaccccgatccacatcgtcctcgtcgtcctcggactcgaagatcccgccccgtgcacggtgcaccccgatgcacatcgtcctcgtcgtcctcggactcgaacggcagccccgacgcaatcgtcctccttcgtaggctgcggccgcggaggccaccgtcggggtgcacaggtggacggggcggcggccggagtcctaccgggggcgggggaagcggggagaggatgacagagaggccttacgaggaagaccacgttcttgggtatggcgcggaggggaaggctggtggaggcagcccagcacgggcgatgccggggatgcaggctcggcggcgagatcgggggaaggggcaggggcgcgacgacccacgagagagggagggtgtgggagggaggagaaggtcgggagggacaccggacgcggaaccactcacaacgtcattggataaaaaattcgggtccgcgaccctgtaccggctgatccacgcgtcagcacccgcgatgggcaaacgcccgtgaagcgcggggagagcctgaaagggggtcagattttaatagaaagagattatactaaagttggtttttggagatgatcacaagagttccttataatgtgatgaccagataagtcaataaccaataaagccaatcagcgatcttccgctaccttcaagccatctaatcgataacaaccaccgagaacatttctatatttctagaactgaaataataaagccataattgatatgattaagtagtactaaaaccatgtcgcctctattgtctgttttgaatgggcttttggctcttgcctattttatttttctttataatgtaatgatatgtaagttctcctaagtatttgagagaaaaaagtgttataattttgttatggtagcacggatttcagtaatagacataacaaaacaggataaagcgtaaactttaattattacaagaaattttatattagtttagcttattcatctcttaggcatcctgatgcttttagaatccacgtcgtatcgaattggacccacgctttacagatcgcatccacgagaacaaagtcgtcgatttatttatacataagtcgtaaagagctaggaaaggccttaaacacatagcagatgtttttagctaaaaggatcatcaaatttcactaagagctagtttacggtcccgtttgtttcctttcatttacggggcgtttggatcccttcattttagaggaattggaattcactcaataaaataacttatttagtttggaatttgacattccaccactttccaaaattctgatataagcctatctcaaattcatggggtggaggatgagaaatgattttatgcattagtagaatttgtttctactctataacttatatgacactcttcgtctcactcctctttagtaaaaatgtagtacataaatatctctgacatcttgctaataatagtatataaatatattttgcataaaaccgaattaacttaattgatatatgcctaaattactattattaggatgcaattcaattccaacgatccaaacgggacgttagagaaattggaatcttactaatgaaatagtttatttttttagaatgcgacattccaccattttccagaattatcatataagcatatctcaaattcatgggttgatagatagaaattgattctatagatttacatgctatttttccgatacacaacttatagcacactcttctacttgcttcgctataacataaatgtagtatataactatctctctcatatgatttaggataatatacaaatatattacatatataaatatatgaacttaattaatttggtctaaattataattattagaatagaattcaattccaacgaaacaaacggggcctgagagatttctatttttcaagagtttcttctaaaaaatagattttttttgagaaaacgggtttctaaacttggtataaaaaataagcaggagcactaaagaagaggagacgtatttcttcctcttcctgaaataggagtcattttatttgcaagactgtaaggtaaagtttggaatgacggtgaacagcagacgccagacggcgagagaaaaaaaaaatgaaggcaaggcgcgcgagggccgcgggggtggccggtcgtcttgtggtgttggtcagttggtgtgtgtgaaaagggtcgcagccggcgacccggcgaaaagccagaatgggcaacgtcgcagcacaccgcaaacgcaaaggggctgtgccgggcgcccgggcggggtccgatccgacgcgagcgggcggaggagcgcgagcctagtgaccagcgcagcgcaccaccaccaacagcaacaagtagccagccactccagcaccagaacgcaacacagacacagagactagagagagagagtcccgaagcgagcacaagaggccaccgcacagcggccaggcggcgagcgagactcctccacacgtctctcccccttcccctccccttccgtttcctctgtagctgcgcccgaccgaacccccctaccccgtggaatcctcctccgatgcggcgccgataggggctggcggaggagcggaatggcggggcacggtgagaagcggcgccgtacgggaggggcccacgagaagccggaggaggaggaggaggaccgcatctctagatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgatctagagattcgtcggaccgtttgagagagggaagggttgaaagagacccggcctttgtggcgcctcaacggggagtaggtttgagagaaccgaacctcggtaaaacaaatccgcgtgtctcacttcattattcgcctacgatttgttttgcaccctctctctcgtggactctattatatttctaacgctaacccggtttgtagttgtgattatttttgagaatttcagttttgccctattcaccccccctctaggcgactttcagcacccatcaggcctttgcggctttgtgctgatgggggttaccagctgagaattaggagtcttgagggtacccctaattatggtccccgacagtagcccccgagcctcgaagggagtgttaacactcgcttggaggcttttgtcgcacttttttgcaaggggaccagcctttctcggttgcgttttgtttcggtgggtgcgcgcgagcgcacccgccgggggtagcccccgaggcatcggaggagtggtttgactcctccgaggtcttaatgcctcgcgcaatgcttcggctggtctggtcgttccctcatgcgagctggccgtagcccgggtgcacggtcgggtcccaagttctcgggctggtatgttgacgctgtcaacggtttggccggagccgggtttgcgagagcagcccccgagcctccgcacagggcgagaggacggtcaaggacagactcgacttttttacatacgcccctacgtcgcctttccgcaaggaggagggggggaaagcgccatgttaccctcggagggcgccgaacatggtgtctccggtgagctgctggcgggtaatccgagtggacgcccgtaccccatttgttaggggtcgactagaggcccggaggcgcgctcaaaagtacctgcgggtgatctgccggacccggtcccctgtcgatggggtccgagggctcgatgcctccctctgatgggatttcgttgcaagatcgttcccgctggtctcggaaatgtcctagggtacctcgggagtgcagcccgagccttgtttatgtatcgaacgtacccagggtcatccctcgctctatgtctgaggcggctgtgaacccttcgagggccagcctacgaacccttgatcagtagtgggcgtggagcccgagtagcctgaggcggccgttgaacccttttgaggggccggccttcgaacctctgaccagtagtgggtgcagaacccacgcgctctgaggcggctattgaacccctccgaggggccagccttcgaacctctgatcagtagggaggctcggagcctgtttccttcacggagaaggatccttttcggggtatccccctttcccggtccctgttgtaagagagagaaagaggaaaaaggaaaaggatacgaaatcgaatgatgtggcgtacctctttggacgcggtcattatagcgaaggcgaagcgtcgcttgcttctcctgccagcggcgccgcctgtcctgtcgcggagttaacgcgacggggcgagtagttcacggggcggccgttgcgcgtgcgcaagccgttcgaggaacggaacacgggcgcgccgtcttcacgccgtgagagagggttctctcgctgcccctggatgggacgtgagcttggctgacgacgtgaccgctgctcctgcccgcctaccaccgccattactgtcggcccattttttgccgtattgaccgtcacgcctggctggcactgctgggtcgtacgcagggttgcctcgagtcgcggtactggttccgcagtcgaggaggcgtggcagtggtgcgagcggcggtgcagttgcttgcacatagcgaccggtgcgccggttacatgacgcgtgggcatgggcccccatgctgggtgcgttggaagtcggaggggcgcgcccacttggggcggttgcatgccgcctgcatggctgcccgccctttcgcccgctggtctgggcgaaggtggaggaatgctcgtaaccgctgggcggttgcatgcaccgcgcgcggcggtttggctccttctgctctgggtcagcttgcatgacgcgtgggacccagcccccacggcgtagggggaggtccttgaagcgtgttggagaagactcagcccacgacggccggggacgcaagtagggagagtcgcctttaaaaggagggtgacccccttgaaaggcgaccatgtctccgcgctccctgatgcatcgtgtctttccaccttctgagcccccggatgggggacacccgcaatccttccgccttgtcgttggaggaacgcaactctgtgggagttggtacctttcggccatcgttcggcttcaaggattttcatcatgcagcccggctgcacccctccgccggcggtcacccaagacggtgacctccagttcgatggcgggggaaagcaagccgggctgcgacctctgcccctccctcagcctcaaggattttcatcatcagtgctggggaggggagtgtgtcgagttggggtcggcccctgcgcgggcggcggcccgctccttccctcagtgatcggggggaagggcgttcgccgttcgtggcactggtagctgccgcatgcctggctctctgacccgagtagcttcggagccgctcccggcgccgccttccggcacggcagctggaagaggttcttccgccgacgagatagctggggccgcccacggaccgacctccaactctacggccttctgcctgtccttgcctcacgagtttgggcacgggcgagggcctcatggcagcagcatccgccctgaggtcatcgctgctgctgttcggccccccggagcagaagtcgtcgtcgtcgtcgctgctggagcgggtgacggcgagccgttcgtcggtcttctgttgctccgcaggccccccaatcgtgtggggttgttcgtacctgcggaggtggaaccggggttccgattgtaatggcacctcaaatgccgatcttttgttcattgtggctgtcggggcctgaacgtgtatgtatttttggcacggagccgtgatttttcctcatcttcgagcactaagactcgcctgttggctgtctgaaccgcttcaccaagcgtgagtcgccccgtgcaaaggtgacgagtgaggtatccgtatcccggaggcgtaggagtccttcggctcggtcggccttgctatccgaggcttctcttgcttagttaaaggaacccctcgaccgctcttcgatgagccgaagccaggggtagcggtgtcagcacggacaaaggcagagttggctcaaaaagaagacttggttggcctgagcctagccgggtcgtccgttagcgggaccgacgccggagttgatctgtcgaggcctcgggccaggctgatgtcttcgggggacagttggccgaggcctcggggtgaccagccgagccgcctgctcgagccggattcttggaggagaccctggcggcgatggcccgggcgtgatgatgacgtcgtccttcaaagtggagatcctcggaccgcgtcgccgtccgaggctaggtcggacctcgccgaaggtgcagtcgacgccgagggtgctgctgctcccttcaactgtcaagacacgagcctgcaggatcggattatcttgtagtgtgtgttttctgcggccgccgaggcctaaacacaccctcgccgtgttgtaaagttgtgcttcttttcctcttatttcgagtatctcgactttttcgtcggtaacagaattgtctgtgcgagcgagagttgcttttcatggaaagtgatgagtgaggtatctgtatcccggaggcgtaggaatccctcggctcggtcggccttgccgcttacacgcactcttgcccgtccatagggttctgccaccgacgcagtcgagaaggcccgaagaatcgcttcgacagaggagctttcgagcgtgaagacttgttcggtccgcggaatcgcttatccgaacgcgagttacttatcgcagaaggtgataagtgaggtattcgtatcccggaggcataggagtccctcggctcggtcagccttggctgcttacgtgtactccgtcgttttcaggatccactttcgaagtagtcgaaaagcacgaaagacattctggcagaaaggatcttttttcgaggaaaatttcgatgcagagggggttccccccttttagcccccgagggagggtcaggctttgccaaggcaaggctgacccttccttgatgactaaactttgtgtgggagcgaggtatatgaacaacttgaaagcatcttaagggtataagcgacatagctgttggatgttccaagtgttgctgtagaccttgccttgactgttggccagcttgtacgttccgggcttcagaactttggcgatgacgaacggcccttcccagggaggcgtgagcttgtgccgccctcgggcgtcctgtcgcagccgaagcaccacgtcgcccacctcgaggtctcgggaccggacccctcgggcgtggtagcgtcgtagggactgctggtaccgcgccgagtgtagtaaggccatgtcccgagcctcttccagctggtccagcgagtcttctcgactagcttggttgctttggtcggcatagaccctcgtcctcggggaaccgtattctaagtctgtgggtaggatggcctcggccccatagactagaaagaacggtgtgaagcccgtggctcggctcggcgttgtcctcaggctccagaccaccgaggggagttccttcatccatcgcttaccgaacttgttgaggtcgttgtagatccgaggcttgagtccttttagaatcatgctgttggcacgctctacttgcccattcgtcatggggtgagccacgacggcccagtccacccgaatgtggtgatcctcgcagaagtccaggaactttctgccggtgaactgggtgccgttgtcggtgatgatggagttcgggaccccaaaacaatagatgatgttggtgaagaacgccaccgcctgttcggacctgatgctgtttaggggtcggacctcgatccacttggagaatttgtcgatggcgaccaacaggtgcgtgtagcccccgggtgccttctgcaatgggccgacgaggtccagaccccacacagcaaaaggccaggtgatgggtatcgtctgcagagcctgagcgggcaggtgggtctgcctcgcgtagaactgacacccttcgcaggtgcggacaattctagtggcgtcggccaccgccgtcggccagtagaaaccttgtcagaaggcgtttccaataagggctcgaggtgctacgtgatggccgcaagcccccgagtgtatctctcgtaggagctcctgaccttcggcgatggggatgcatcgctggaggatgcctgaggggctgcggtggtagagctccttcccatcccccagcaaaacgaacgacttggcgcgtcgcgccaaccgccgagcttcggctcgatcgaggggtagctctcctcggtggagatattgcaggtacggggtctgccagtttcgattaggcgtgaccccgcttcgctcctcctcgacgcgcagtgcctcaccctcgggggccgagggtacctcgggctgaaccgagggtgcctcgggccgagcggagggtgcctcgggccgagccgagggtgcctcggactgagccgagggtacctcgggctgggccgagggtgcctcgggctcgggcgtgtcgtcgatcttgacggagggttgatgcaggtctcgggagaagaggtccggggaaccgtagttcgccccgaggctattttagccagcttgtctgcagtctcgttgtagcgtcgggcgatgtggttgagctcgagcccgtagaacttgtcttccaggcgccgaacctcatcgcagtaggcctccatcttcgggtcgcgatagtgggagttcttcatgacttggtcgatgacgagctgcgagtcaccgcgagcgtcgaggcgtcggacccctagctcgatggcgatccgcaacccgttgaccagagcctcgtactcagccacattgttggacgccgggaaatggaggcgtagcacgtagcgtaggtgcttcccgagggccgagatgaagagtaggcctgcgccggctcctgtcttcatcagcgacccgtcgaagaacatggtccagagttccggctagatcggaactgttgggagctgggtgtcgacccattcagccacgaagtccgccaagacctgggacttgatggccttccgaggggcgaatgagattgtttcgcccatgatttccaccacccacttcgtgattctacccgaggcctctcggcactggatgatctcccctagggggaaggatgacaccacagttaccggatgagactcgaaatagtgtcgcaacttctgccgcgtcaggatcaccgcgtacagcagcttctggacttgtgggtagcagattttggtctcggacagtacctcgctgatgaagtagactggcctctggacgggcaatgtatgcccctcttctcgtctctcaaccacaatcgcggcgctaaccacctgagtggtcgcggcgacgtagatcaagagggcttctccggcagcggggggcaccaagatgggcgcattcgtgaggagcgccttcagcttcccgagggcttccttaagaggcggtacagaggcaggcctctttcgccgaggcgcgagatgaagcggctcagagccgcaagacatcccatgactctctgtacgcctttcaagtccttgatgggccccatgctggtgatggctgtgatcttctccgggttggcttcgatgccccgctcggagacgatgaaccccaagagcatgcctcggggtaccccgaagacacacttttcgggattgagcttcacgcctttcgccttgagacatcggaatgtcacttcaaggtcggaaaggaggtcggaggctttcctcgtcttgactacgatgtcatcgacgtaggcctcgaccgtccggccaatgtgttcgccgaacacatggttcatgcaccgctggtacgtcgcacccgcattcctcaagccgaacggcatggtgacatagcagtacatgccgaaggacgtgatgaaagaagtcgcgagctggtcggactccttcatcctgatttggtgataccctgagtaggcatcgaggaaagacagggtttcgcacccagcagtggagtccacgatttgatcgatgcgaggcagagggtagggaaccttcggatatgctttgtttagaccagtgtagtctacacacatcagccatttccctcctttctttctcacaagcatagggttggcaagccattcgggatggaatacctctttgatgaaccctgccgccattagcttgtggatctcctcgcctatggctctgtgcttttcttcgtcgaatcggcgcagaggctgcttgacgggtcgggctccggctcggatatccagcgagtgctcggcgacatccctcggtatgccgggcatgttcgagggactccacgcgaaaacgtcggcgttcgcgcgaagaaagtcgacgagcactgcttcctatttgggatcgagctcggagccgatccggatctgcttggaagcatcgctgctggggtcgagggggacggacttaaccgtctccgctggctcgaagttgccggcgtggcgcttcgcgtctggcacctccttcgagaggctctccaggtcggcgatgagggcctcagattcggcgagggcctcggcatactccacgcattcgacgtcgcattcgaacgcgtgtcggtacgtggggccgacggtgatgaccccgttggggcccggcatcttgagcttgaggtaggtgtagttggggacagccatgaacttcgcgtagcatgacctccccaacactgcgtggtaggttcctcgaaacctgaccacctcgaacgtgagggtctcccttcggaagttggagggtgttccgaagcagacgggaaggtcgagttgtccgaggggctggacgcgcttcccggggatgatcccgtggaaaggcgcagcacctgcccggaccgaggacagatcaacatgcaggagcccgagggtctcggcgtagatgatgttgaggctgctgcctccgtccatgaggaccttggtgagcttgacgtcgctgataatggggtcgacaacgagcgggtatttccccgggctcggcacgtggtcggggtggtcggcttggtcgaaggtgataggcttgtcggaccagtctaggtaaactggcgccgccacctttaccgaacagacctcccgacgctcttgcttgcggtgccgagccgaggcgttcgccgcttgcccaccgtagatcatgaagcagtcgcggacctcggggaactctcctgcctggtgatcttccttcttgtcgttgtcgcgagccctgccaccctccgcgggtggcccaaccctgtggaagtggcgccgaagcatggcgcactcctcaagggtgtgcttgacgggcccctgatgataggggcacggctccttgagcatcttgtcgaagaggttggcacctccggggggtttccgagggttcttgtactcggcggcggcgacaaggtccgcgtcggcagcatcacgtttcgcttgcgacttcttcttgcccttcttcttggcgccgcgctgagttgatgcctcgggggcatcttccggtggcggccctggggctgcttgtccttccggaagatagcctcaaccgcctactggccagaggcgaacttggtagcgatgtccatcagctcgctcgccctggtgggggtcttgcgacccagcttgctcaccaggtcgtgacaggtggtgccagcgaggaacacgccgatgacatctgaatcggtgatgttgggcagctcggtgcgctgcttcgagaatcgccggatgtagtcccggagagactctcccggctgctgtcgacagctccggagatcctaggagttcccagggcgcacgtacgtgccctgcaaattgtcggcgaaggcttggaccaggtcatcccagttggagatctgccccggaggcaggtgctccaactaggcgcgagcggtgtcggagaggaacagggggaggttgcggatgatgaggttgtcatcgtccgttccacccagttggcaggccagccggtagtctgcgagccactattctggtctcgtctcccccgagtactttgtgatagtagtcggggttcggaaccgggtcgggaacagcgcccgtcgtatggcgcggctgaaagcctgcggaccgggtggttcgggcgagggactccgatcctcctcgctgtcgtagcgtcccccacgcctggggtggtagcctcggtgcaccctctcgtcgaggtgggcccgacggtcgcggtgatggtgctcgttgccgaggcgacctggggctgcaggcgctgtgttgcgcgtgcgcccggtgtggaccgaggcttcccacatgaatcgggaagtcacggcgcgatgttccgaggggtacccctgccttcgggaggcggagctttcggcccgtcggaccgcggcgccctccaggagattcttgagctcttcctggattcgccgcccctcggtggttgatggctccggcatcgcgcggagaagcattgccgctgcagccaggttctggccgactccactggaagcgggtggcggcctcaccctgacatcatcggcgatgcggtgctggaagccctggggtagatgacacacttcctcggccgaaggttggcccgccccattcctgcccgacgtcccggcggatcggttcaagtgtttcctgctccctcgtcgagcctggcttgcaccccgtggatttgctcgagctgtgggtcatgaccctccgcctaaacggggaccactgctagctcccgtaggatgtcaatgcgaggcacaggcctagggagatcaccgttctccggcataccaagatggttgccttcggagggaccccctagatcgacgtggaaacattcacgacttgggccgcagtcctcgtcgccgaggccgcggctaccgtcggaatagtcggaaaggcagtagtcgcatgcggtcatgaagtcccgcatggcactggggttaccaagtccgaagaaatcccaacagaagtcgggcacgtcatcttcctcggaccccgagggcccgtaggtcgagacgtccatcagccggtcccagggtgaccgcatacgaaaccccagagggtttggactcgcctctacgagggcgtccgccaaagcgaagtcgcttggcgggtcgaggctgaatccaaaaggcgtgagatgggaatcggtgggtacctcttggtcgacgagcggtgacgaagttacgtcagggactgactgcaccgtcgtctcaggtacgagggtgacgctcagcaagccttccgcgagcgtgttggcgtcgtctgtttgcttggaattggcgtgttgcggggagacgacgctcgtcttcgtctcaaacgcgaggttgatgcccgacgcgccccccgttggggcgccggcgccgtcgacttgctcgacaaccgacgaggtgccgcctcctgcttggccttggttgccccgcctcctcctccgtcggcgggggagagggctgggtgagctcgaatgttgttcttccaccacgcgaggaagacgtcgtcgattccgccgccagcgggcgggctgtcggccgccattgtcgttgtcgcacgacgggggaaggagtaccatgtcatagctaccgtcgagggacatgaactcaagactcccgaaacggagcatcgtcccgggctggaaaggctgctggagactgcccatctggagcttgacgggaagctgttcgtcaacatgcagcagaaggtcgtaggttcgacccctacctggcgcgccaactgtcggcgtttcgataccggggggtccctgggccgacgagtgaaatgttgccgcgtgccccagcccagatgggtcggcgcgagacggagcgcgaagggggggaaaaggcagccggagcgagagagagaggtggaaatcccgcggccttcgtgtttgtcccgcgcccaggtcgggtgcgcttgcagtagggggttacaagcgtccacgcgggaggggagcgagcggcctcacgcgagcgcctgtcccgtcctcttccccgcgcggccaaccctctctaagagggccttggtccttccttttataggcgcaaggagaggatccaggtgtacaatggggggtgtagcagagtgctaacgtgtctagcggaggagagctagcgccctaagtacatgccatcgtggcagccggagaggttttggcacccggttcgtgtggtgtcgtggccgtcggaggagcgctggagcctggcggaaggacagctgtcggggctgtcgagtccttgctgacgtcctcttacttctgtaaggggactgagagccgccgtcgtcatagagcgtgaggggcaccatcattgcttgtctagcggagcgagccagacgggatgccggtcttgtttcccgtagtctgagtcagcttggggtagggtaatgatggcgcctcatgttgacgtggtcggtccgtgccctaggttgggcgatgtggaggctcctccgaggtcgaggtcgagtctgtcgtccgaggtcgaggtcgagtccgagcccctgggtcgggcgaggtggagaccgtcggctgaggccagggctgagtccgagccctagggtcgggcgaaacggagttcgtcgtcttccggggctgagcccgagtccgagccctgggtcgggcggagcggagttcgccgtcttccggggctgagcccgagttcgagccctgggtcgggcggagcggagttcgccgtctttcggggctgagcccgagtccgagccctaggtcgggcggagcggagttcgccgtcttccggggctgagcccgagtccgagccctgggtcgggcggagcggagttcgtcatcttccggggctgagcccgagtccgagccctgggtcgggcgaagcggagtttcctatggtgcctgaggccgggcctgactgcctgtcagcctcactccgtcgagtggcacagcagtcggagcggagcaggtggcgctgtccttctgtcaggccggtcagaggagcggcgaagtgactgcggtcacttcgactctgtcgactggaggacgtgcgtcaggataaaggtgttaggtcacctttgcattaaatgcccctgcgatttggtcagttggcgtggcgatatggccagggttgcttcttggctaagactgggcctcgggcgagccggaagtatgttcgtcgctggaggggggcctcgggcgagacggagatcctccggcctccggggtcggttgcccttgcccgaggctaggctcgggcgaggcctgatcgagtccctcgaatggaccgatccctcacttagtcgcacccatcaggcctttgcggctttgtgctgatgggggttaccagctgagaattaggagtcttgagggtacccctaattatggtccccgacaagaaccatagatccacccaatccgcggtgcaccatattaaagacttaaaatgaataaacatttatttttcttcaattcaacaaatatatcatttccaagaatgaagtagtgtcgggaaccataattaggggtaccctcaagacgcctaattctcagctggtaacccccatcagcataaagctgcagaggcctgaagggtgcgattaagtcagggatcagtccatacgagcgactcgatcacgcctcgcccgagcctagcctcgggcaagggcagccgaccccgaggggtttccgtctcgcccgaggcccccctttttaacggcggacacatctccggctcgcccgaggccttgccttcgctaagaagcagccctgactaaatcgccgcgccgaccgaccgagtcgcaggagcatttaacgcaaaggtggcctgacacctttatcctgacgcgcgccccccggcagagccgaagtgaccgccgtcacttcgccgctccactgaccggtctgacaaaaggacagcgccgcctgcgccactccgactgcagtgccacttgatagagtgagactgacatgcagtcaggccttgccaaaggcgccataggaaactccgctccgcccgacccagggctcggactcgggctaaagccccggaagacggcgaactccgctccgcccgacccagggctcggactcgggctaaagccccggaagacggcgaactccgctccgcccgacccagggctcggactcgggctaaggccccggaagacggcgaactccgctccgcccgacccagggctcggacacgggctaaggccctggaagacggcgaactccgctccgcccgacccagggctcggactcgggctaaggccccggaagacggcgaactccgctctgcccgacccagggctcggacacgggctaaggccccggaagatggcgaactccgctccgcccgacccagggctcggactcaggctaaggccccggaagacggcgaactccgctccgcccgacccagggctcggactcgggctcagccccagaagacgacgaactccgcttcgccccgaccccagggctcggactccgccctggcctctgccgaacaacctccgcctcgcccgacccaggagctcgggctcgggctcggccatggaagacagattcaaccccggcttcggaggagcctccacgtcgcccgacctagggcacaggcccgccacgtcaacaggaagcgccatcatcactctaccccgagccgactcgggccacagagaacaagaccggtgtcccatctggctagctccgccagataggcaatgatggcgccccgctagccctgtgacgacggcggctctcagctcccttacggaagcagggggacgtcagcaaggactcaaccgctccgacagctgtccctccgccaggctccattgctcctccgacagccacgacatcacaccagcagggtgccaagatctctccggctgccacattggcatgtacttagggcgctagctctcccccgctagacacgtagcactcttctacacccccattgtacacctggatcctctccttacgcctataaaaggaaggaccagggccttcttagagaaggttggccgcgcggggacgaggacggggcaggcgctctcttggggccgctcgcttccctcacccgcgcggacgcttgtaaccccctactgcaagcgcacccgacctgggcgcgggacgaacacgaaggccgcgggatttccacctctctcacgcccgtctccggccacctcgcttccccccttcgcgctcgtccacgcgctcgacccatctgggctggggcacgcggcacactcactcgtcggcctgagggaccccccagtctcgagacgccgacagttggcgcgccagataggggcacgctacgtgttgacgagcagtttcccgtcaagctccagatgggcagtctccaacaacctctccaacccgggacggtgctccgtttcgggagtcttgagttcatgtccctcgatggcagctacgacatgatactccttccaccgccgtgcgacaacgacaatggcggccgacgacccgcccgccggcggcggaatcgacgacatcttccccgcgtggtggaagaacgacattcgagctcgccccgtcctctcccccgccaacggaggaggaggcagggcaaccaaggccaagcgggaggccgcgcttcgtcggctatcgagcgaatcgacgtccccagcgccccaacggggggcgcgtcgggcgtcgacctcgcgtttgagacgaaggcgagcgtcgtccccccgcgacacgccaatcccgagcaagtggacgacgccagcgtgctcgcggagggcctgcaggacgtcgccctcgtacctaagacgacggcgcaatcagtccccgacgtgactatgtcgctcctcgtcgaccaaaaggtactgactgattcccatcctacgtcatttcgactcggcctcaacccgcctagcgacctcgctttggcgggcgctctcattgaggcgagtgcaacccctctggggtttcgtatgcggtcgccttgggaccggttgacggacgtctcgacctacggaccctctgggtccgaggaagatgacgatcccagcatctgctgggatttctctggatttggcaaccccagtgccatgcgggactttgtgaccgcatgtgactactgcctctccgactgttccgacggtagccgcagccttgacgacaaggactgcggcccaagccgcgaatgtttccacgtcgagctaggggatccctccgaaggcaaccatctcggcatgccggaggatggtgatctccctaggctggtgcctcgcgccgacatcccgcgggagctagctgtggtccccgttccggcggggggtcacgacccacagctcgagcaagtccgcggggcgcaggccaggctcgacgagggagcaggagcgctcgagtcgatccgccgggacgtcgggcaggtatgggcaggccagcccccggccggagaaatacgtcacctgccccagggtttccagcaccgcgtcgccaacgacgtcagggtcaggccgccacccgcatccagcgaggtcggtcagaacctggcagccgcggcgatgctcctccgcgcgatgccggagccatcaaccaccgagggtcggcgaatccagggagagctcaagaatcttctggaaggcgctacggcccgacgggccgagagctctgcctcccgaaggcagggatacccctcggaacctcatgccgcgacttcccgattcatgcgggaagcctcggtctacaccgggcgcacgcgcaacaccgcgcctgcggccccgggccacctcggcaacgagcaccatcgtcgcgaccgtcgggctcacctcgacgaaagggtgcgccgaggctaccaccccaggcgtgggggacgctacgacagcggggaggatcgaagtccctcgcccgaaccacccggtccgcaggccttcagtcgggccatccgacgggcgccattcccggcccggttccgacccccgactactatcacgaagtacttgagggaaacgagaccggaactgtggctcgcagactaccgcctggcctgccaactgggtggaacggacgacgacaacctcatcatccgcaacctccccctgttcctctccgacactgctcgcgcctggttggagcacctgcctccggggcagatctccaactgggatgatttggtccaagccttcgccggcaatttctagggcacgtacgtgcgccccgggaattcctgggacctccgaagctgccggcaacagccgggagagtctcttcgggactacatccggcgattctcgaagcagcgcaccgagctgctgagagcacctagaggggggggtgaataggtgatcctgtgaaacttaaacttatagccacaaaaaacttgttaagtgttagcacaataatcgccaagtggctagagagaaggtcttgcacaatacgataatcacaaagaattcaacacagagaagacacagtgatttatcctgtggttcggccaagtacaaaacttgcctactccacgttgtggcgtcccaacggacgagagttgcactcaactcctctcaagtgatccaatgatcaacttgaataccacagtgttatgcttttcttttcttatcccgttcgcgaggaatctccacaacttggagcctctcgcccttacacttttgatgttcacaaagaatcacggagtaaggaagggaagcaacacacacaaatccacagcaaaatgcgcacacacacggccacgaatcgagctcaaaagactatctcaaagttctcactagaacggagctcgaatcactgagaatgacaaacgaatgcgcaaagactgagtgtggatgatcaagaatgctctaaggttgcttggtgtgctactccatgcgcctaggggtcccttttatagccccaaggcagctaggagccgttgagagcaattctggaaggctgatcttgccttctgtcatcgggcgcaccggacagtccggtgcacaccggacactgtccggtgcccgatctccttcctaaaatggcgcagccgaccgttgcagatctgggagccgttggcgcaccggacatgtccggtgcacaccggacagtccggtgtccccttccgaccgttggcccggccacgtgtcgcgcgcagattccgcggccgaccgttggcccggccgaccgttggctcaccggacagtccggtgcacactggacagtccggtgaattttagccgtacgtcgccggtgaattcccgagagcggccagttcgctcgagccagcctggcgcaccggacacagtccggtgcaccaccggacactgtccggtgcaccaccggacagtccggtgtgccagacagagctgagtcttggatgtacacagccaagcctttttcacctcttttcttttcttcttctttctgtttctaacacttagacaagtatattagtacacaaaaccaatgtactaaggcttagaaacatacctttactcttgatttgcactttgttcatccatgggcatagattcacatttaagcacttgtgttggcactcaatcaccaaaatacttagaaatggcccaagggcacatttccctttcaatctccccctttttggtgatttatgccaacacaacataaagcaactagaacaagtgcaatatcacttcaaataaaaactcaaatttattttgattcaatttggcatatatggatcatcctttgccaccacttggtttgtttttgcaaatcaaactcaaaatcctatctctaagtcaaatccacttgtagagacataaagagaggttttccaaagaaaattgattcaagattccaaaaactccccctttttcccataatcaacacttctccccataagaggccaacttttgacaaaagagacaatgcaagagttatgacaaaccaaaagctctatcctactgttttcaaattttctcaagtggtagctgatccatttattgctttggcctttattttctccccctttggcatcaagcaccaaaacgggatcaatcttggccctttaaccccattgcctcaccaaaatcttcaattaagagcaaataggcaataagagtttaaagatgaacttggaataagttaccctctcatcggagtgcagtggaagtctttcacggtccaagtccacctttccctttcaaatcttctttgagactaacacaatcaaactcaagcaaacggttagtctcaaagggtcaagttgtaacacatctccccctaaatatgtgcattactggcacaaggacttgtgaggtccggggagtgcttgtacaacttgagcaccataataagcaacacaatgcagaatgaacatgattaagggtataaacacatgtatgctatatttcaatccaagttccgcgaatctaagatattgagctcactacgcagcctacagaaggtcttctcatctagaggcttggtaaagatatcggctagctggttctcggtgctaacatgaaacacttcgatatcccccttttgctggtggtctcttaaaaagtgatgccggatgtcaatgtgctttgtgcggctgtgttcaacaggattttccgccatgcggatagcactctcattgtcacataggagtgggactttgctcagattgtagccaaagtccctgagggtttgcctcatccaaagtagttgcgcgcaacactgtcctgcgtcaacatactcggcctcagcggtggatagggcaacagaggtttgtttcttagagttccacgacaccagggaccttcctaagaattggcacgtccctgatgtactcttcctatcgaccttacatccagcatagtcggaatctgagtatccaaccaagtcaaagagacccctttggataccagagcccgaagcagggcgtagcaaccaaatatctaagaattcgcttcaccgccactaggtgacactccttaggatcggattgaaatctagcacacatgcatacgctaagcataatatccggtctactagcacataaataaagtaaagaccctatcattgaccggtatgctttttgatcaacggacttacctcctttgttgaggtcggtgtgtccgtcggtccccatcggagtttttgcgggcttggcgtccttcatcccaaaccgctttagcagatcttgcgtgtacttcgtttgggagacgaaggtgccatctttgagttgcttcacttggaacccaaggaagtagttcaactcgcccatcatcgacatctcgaatttctgcgtcatcaccctgctaaactcttcacaagacttttggttagtagaaccaaatattatgtcatcgacataaatttggcacacaaacaaatcaccatcacatgtcttagtaaaaagagttggatcggctttcccaaccttgaaagcattaacaattagaaagtctctaaggcattcataccatgctcttggggcttgcttaagtccataaagcgccttagagagcttacacacgtggtcggggtaccgttcatcctcgaagccagggggttgctccacgtacacctcctccttgattggcccgttgaggaaagcgctcttcacatccatttggaacaacctgaaagaatggtgagcggcatatgctagcagatacgaattgattctagcctagccacaggagcaaacgtctcctcaacgaatctctagttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccgaaggggaccacgagaaaaccagaaaaggagaaggaaaaccgcaattaaatctcccggacgtccggcgcctgcacattagaactggcgaacgctcaaatgggccaaagcaaaggcgcgctctcctcgcgcaggaaccgaatctggggttgccggggccggagccctcctcggtgaacatccgcctcccccccggcgcggcgggaaagaaaaaacgagacgcgcaccgaggcgcaggccgggatcgaccgccgcgggcagcgccgcgtcgacggcttctcgctcgcctttccaagggggccagctggcgcacgcggacctcaagcgctgcgtcgattacgccggcggcgtgcgaggccgaggacctgcacctccgcgccgacggcgggcgcgggcgccgccccggggctcgcgcggggccacgcgccgcccggggcgcgctcgcccgtgcagttccccgtcgggagcccgctgctcgcgcgcctgtcggtgcgggggctcagcctcacggccgtcaacaacgccatggtcgccacgctcgaggtgatccacctgcactccgtcttcctcacggacgccgcgctgcgccggatggtcgccgcctgcccccgcctccgggagctcgacctccgttactgccgccgcctgcgccgtgtcgacttcagcagtgttggggtgcccaacctcagtagcttcaccgtcgtcgactgctcccgcaccaccgagctccgggtccctgtcgcgccccgtctccggtcgttccggttcagcggtaccttcctctccagcaacattctctctggagctaagggttctcttgagcatctctacctctgctctggcgggccagagaccggccttcccgccaccaacttgccctacgcagttcctcgcctgtcgaacctcactgtcctcaccctctgcagcattgctctccaggtttgctcaggcgtctgtgccatttcctttcagcccattttactgcctcaacgcttatacttgtttgccttgccttgtagtatgtttcttctttcacagccaaggccggctcggagggcaacctgcatggcttaagggagctccagttgctcacgttcgggatggccaactccaaccttgctgacatttatagcttcctcaagacctgcccgtgtcctcgcttggagcgtctctttgtgcaggtctctattttttcttcttacttttcatgaaaaactgcattcaactgtttatattgtttatggatatctgatctttttgtcaacatgctccaccggacatgcagctcccgacaaacaccggtgatgcattcacggagaatttcttggaggtggcggaggaggatccaccaaaaggtggattagaaaacctttgcttagccaagctgacaaatttcaaggggcaccgcaatgagatgcaactagtaggatttctgcttagaaagtcttgtagtctgaagaaactatttctgattgctcctaaggaggatcaccctcaaggactccgcaagacactgtcagatacgctgcctgattttctaaaaaaagaaatattgcatctggaaagagcttcaacagatacgcagatatttttcagtgagcctgatgctcagacgcagcaattgcattcggaggtctttgtcaggttttagcttgaaatgaggaaatgctgttgtagtccagtttctgctcctatagttttagatttctagcctttagagaacagacatggggaaaaaagtatctgcaaggcatacatagttttgatatatgttttctttttgcaatttgtgttactaaagaagtcctgcatagcggttgaaatgagagctgttctgatcttccacattttcttcttctcatccctctcttctccccctgtttgtgttcgcgatctctttggagttggcttattataagttgctgttgtacacagccaaccatctattggaacacaacaaccttcattttatttgtcgtacaattgaattggtaggttaactttgtggttctagatagatggagcatgtgcatatctcttgcttaatctgggagttgcattatatttttcttttcagttttttcctaaataggtatagtttctgtttctgagctaagtttcatataacttgtcatctgtcttgagtcattcatgtaaaaaagatgtatcaggggaatcttataaaactgtctttttgtgcggttaggattatattaacctagtatatatggactctacatctgctttctctgtttgttgtatgggtgaaattattgttgcttagatgggacatgtgtcttaaagcgatataatcatatggacttctgtacattaaagctttctttcatattatatccatgatactgcagatctctaagggaactatcatttcttgtacttccatcctggttgtcttgtgtgtctgcaaaacctggaacacctctgaatgacagagctcctgccttttttcttaaaaaaataatatatagttgacagtctgttgttggcagtattggtttacatccttaaaatgtcatacacgggttgttcaggacttcaggtgaccaaattcatatgtgctcattttggtgttactggtgaggtggtgaggaggtgtatttattttgatgtcattgagttttagtggtggagctagatgagatgaaatgctttggactctggtgttcttagctagctttgcaggatgaaaccatatttgtggaaattctatggtgctccttttgtgaagtggaagccatatcaccgtagtgctttgcacttatgtcttatccttcaaaccatgcagagctgtagtgccatacatcatagcaaaatgatatggataatgttggtaaaggtgtctagtagctttgagaattcttatgcacttgtatgtttgaagcagccatatccgtgcatacccttcatatttttgaattgaatcaattatttctgaaactttaggctggccgctgcctaataatctccagctacaaggaatcatacttgatgcgaagttgtggaaatggatttttgatttatgcagcttggtgtttcaagatatattacaagtgacgtaaaatttatgtggttctgttgggagcaacatgttggccacttgactattaacatgcaatttaccgttgcttttttactcaatgtgtctatctgtactgcttcatatatggaaatgtaagttagcatactcttttagacttgttttaatatcaatagaaatgcacacttgaagtatacctttgcagcaagctgtgttcagtaaccagtaagcatttttactacttcctccattcctccaaattataagacttttttatttttctagatatataattttttctacgtacttagatatacattatatctaggtacatactaaaagtaatctatttaaaaaactaaaacgtcttatagtttggaatggagtaagtaaatcttttaaatactggatggaaaccattaatctattgtgatttctttctcaatgccagttttttcattaatctttgctattgtgtagtttgcaatcatagaacagatttgttggaaaagtactttacctatctattttctctatttacattgccaacttgtaaaacataggaataagagagtgcatacaatatcttaaaagagagtgatatgctgcttcagaaaagattgcttatgctgatgagaaaaaaaagaaggtatatcctactttgtgtgaattagtggtggggctactgggattgaccttgcagtggagatgcacaattttattattcaacccttgtagatatatccacactccaaactttgttaagatatgtgttattcaatctgaaagatatgttgttcgacctgtgtgagaactgagaactgagaaggtcttcttcttaatacaatacttggggttgtctcatcctccctaggtcgagttttttatattcattatcatttgaatgaatgttttgacagaaaaaatgggctaaaaagaactatattttgggacggagagagtatatgttagggcagagacaactcttgtttgcaacaccgctcttagctcttttgagtaatgtatgctaactttcttgcaacttgataaatgattttccattgaagggacctgtacacttaagtaattaactaacggggttaatggtgtctgtgaataactggtctaccttcaataactagaataacacagcagcaaagcatttttaatctcaaacaagttgagtaacaagtaactatagaataccatgaaaagaacgatctttgaggattgggggatttatcgagttaggattacacgtaaacatcgaatctttgacatgggcatactgatttagcttttacatagtagttttatgaagaactgaaaacttgagatatattcagatgtctgtaacgtttggcaacaggcatctgcactatctaagcacttgtattcaggtgcgtcgtctgtctgcaagctatatcttgtccttcctgtcatttccgcagaatgtgtttacgatcctgcactcatgtttctaatgtttcgtgatcagattcagatggatgcctgtatggtcccgcactctattttaaatgatcggtaagcaaatgttccatttttattgaaggctagtatacactaatgcgtccttatcttctcttaatttttcttgtcctttctagtacattgtacatgtttttccctgagccttctatttcactatactctaacagtatgtgtgtggccaattaggccctgtttgggaacaaagtttttgaaaactacagtttttgaaatactatactatactttagttatgacaataccgtagtttataataccgcagttttgaaaactgaggtccagagctaagtttagaatgccttaaaacaactatagtatttgcaatacttcagttttgaaaacagagattttacccagcttgccaaacaccattatgtatataatactgcagtatttgagaatactgtagtattcttccaaaactgcagaaaaactttgttcccaagcacccccttagactttttgttctgtaatactagtgtacgtatgtggggcgggggtgggggttctgtgttcagaattaagactgcatttattgttgtctagtccttgcatttattgttgtctagcaactgtgctacagtatggttgcccaattcattataattactgatttaacaaatagtcctaccccatccacaaagttgctagggcatagagtggagtgcatgaccaatttattataattactgaattaacaaatagtcctactcctaccctatccacagttgctagagcatagcttattgattgatgcctgtaactactacggctcgccaaacatctgtagccccttactctacatgccattgattcatcctatagtatgggctcgcttattctgatagattacagcaacctcattcaagtgttggcgtgcagagttcttagtttgtgtgcatttgattgatagcttatttttgcagagatgtcttgctcatttcttttgtcacttgggttctttctagtctcacatttgttattttggtggagggccttctcggcgctgcatccagttatttttttgggattgtagctgccctgtccagtagctctccacattgggcacatcgcacctctattttgttgttctcaagtttttttatttgtgtgcttagtgcagactgcagggtacccacaattgtccttttacgtttttttaaaaaaaaagtacggaccttgcattgtgagctaacgaaggcactggtcgctcgatcacatgggggtgtggtctgtggtggaccggcagtactgtctcaactagccaatggtccacagtatcagtacctgctccgtgctcaccaaccggtaccggttctccatcgcgtgcacctcgtgttaaaaatattttgtactctctctgttctgattaatgtaactctcaagtctcttactctttatttctttttttataagttaaacgatttaaactttaactaaaatcgtgcaacatacttatattataaagtagatatcattacactgatggaatgcgtttttagtaaatttgatttaagacaagtattagtactatttattataaatttagtcggacataagctagttttcttgtattattttatgcactggagagtaataacttatctcatgcaatgtgctcactccatccataaaaagatgtaattttcgtttttctgtaacttgaccaaacttatatataggaaaaatagtaccattcataatataaaacaaacatcattagattgattataaaatatatttccatagaaaattttattgtaaacataaatgtaaatagtatatattataaatttgatcaaacttaaactagtttgatcggcacaaatctatacttgcattctatgtggatggagtagttagcctcatgagactgaataattggcggcctgcacttcgcatttcgtgcactggtgcatcttccatcctcgggtttatgggatgaataatacttcagtaaatcccatctttgttaccattttattaagattgttgaggtgttcattgatatgatagataacgctcatatttagccatttaggctcacagttcagtaaatcaatcatatagtagatgacatgatactgtcactcacgccactgttccttccactgcaagtatgtctactgtaattaatcacttacttttggtgcctggcagcttccctccacacgatgcggtagacaagtgggaaaaggtaaatgtgcacccaaccttttattatactcctattagcaagcataataaagactatatttgtacctctagcagtggactatattattaaccttgcatgctcttgctctaagatgaagcctacatcagctagctatgtacagaaagcaccatgtttccgatgggcccacccgtccccagagttgcaacggaaggatctaagctcttcaggaacgcgggtgaggtgaagtgaagacgatgtccgtgacgccggttcagagctggtgaagttctctagcaacgggaagaagagggtttttaaggatgcttccgcttcaaaaaagctaaaagaccaattaatggtttttttgccttttagaaaacaggtgtttttagtatgtttctaagaatacttcagacacttttttattattttttttggtttttaatattttttaatgaatggaataaacaatttattcatggttgttgtaagagataaagataagaggtatattttacacctgtttttttttttttgtagatgataccctataaagttataacagttttttatagctcatagtcaaatgtagtttttcttcaccgccacagttgaaccgaatagacacttaatactacgatgatacacaaatcttctcaacaatcgagaaagagaagaggtagtctatgggtgacaatgtgctctaaattttacaccataagatttaaggatcagatcggattaagatcatgccttatttttatttatttttaaaataaaatttatttaaaactctgtcattttgtgaagaagtatttggatcataatccattatcatccctatgagtgtccatacatagacgccacattctgactctaaggtactatcctattgaatctcaagtctcaactacagtatgcttagggcttgtttggaagcgaggagaatgaaaggatttaagagggctagaatccttcgttattcaaaattgaatattgggcgattctaacccctaaaagtaaagaggctaggatccttctttatttaaaattgaatagtgagagattttaacctctcaaacctatttattcctcttgctaccaaacaagcccttaatttcatttaacagagggagcaaaagtgcttgcatttgcctccgtccggatgacactcacactcttgagcctacctacagcagaacgaactcgaaagttgctcgacgacgaacagcctgcatgcatcatgcgacatgctaaaaatgggaagagggagttctctccaggattaggcggtgcatgcgaaatcgtggctgacggttgaaaccacggagacattcttggggagggacgacacgagtagcaccggagagaacgcgcgcatggcgaccaccgtgccatgcatgcgtccgacgatttaggacgggacacacggcagccttctgccaatcgcgcacgtaccaccattgccgccgcgccactcgccgagcccttccccggtttaagtgctcactgctctggccttgacgcattcttgtttggacacatacgtacgtgtgaaggaccaacacgagggccgggcgcgcaccccccctctatctctcccgccgccgttgatctatcaccgggccgccggtccgtgactgtcgccagcggctgctggttgttgcttggttgcgtcgccgcgggacccgtgacccgggcgcaatgccgggagccgtgatcgtgcaccaccacacgaggtacaagacgtaccccggcgaggtcaccggcatcgccatcttctcgtgcttcatcgcctccgtcgccggctgcatcttcggctatgacatcggcctcacatgtgagtgacgcacaccgtagtagaatcaagctgtgatctcttctcgagctagctggagcttggcttgctctgactctgacgtcgtacggttgttgttgttgccacgctgtcgccgtcgccgccgtggtggtcgtacgtgaagccgggctgacgtcgacggagccgttcctggtcaagttcttcccctccatctacgaggagatgaagaggcaggtggtcgtcaaccagtactgcaagttcgacagccaggtcctgacgctgttcagctcctccctcttcctcgccgcgacggtggccaccttcttcgccggcccgatgacccgcgccttcgggcgcaagtggaccctgttcgccgccgcgtccgcgtacgtggtcggcgcgtgcatcggcggcgtgtccgtgaacttcccgatgctgctcacgggccgcgtcctcgtcggctccggcgtcggcatctccatccaggcggccccgctctacatctccgaggtggcgccggcgcagcagcgcgggatgctcaacatcctgttccagctcatgatcacggtgggcatcctgacggcgaacatgaccaactacctggcgtccaaggtctcgggcggctggggctggcgcatccccgtgacgttcggcgccatcccggccgccgtcatcgcgctgggcgcgctcgccatcccggacaccccggcgtcgctcgtcgagcgcggggacacggccacggcgcgcaagacgctgtcccagatccggggcgtcggcgacgtgcgcgaggagttcgacgacctggccgccgcgagcgaggacgccaaggccgtgcagtgcccctggcgggagctcttcttcggcggcaagtacaagccccagctcacgttcgcgctgctcatccccttcttccagcagctcaccggcatcaacgtcatcatgttctacgcgccggtgctcttcaagacagtcggcttcaagcagaacgccaccctcgtgtcctccgtcatcaccggcctcgtcaacgtcttctccaccttcgtcgccatcgccaccgccgacaagatcggacgccgcgcgctcttcctgcagggcggcacgcagatgatcatctcccaggtaaaacacaacaccgccattaatgaaatgaattagcctccatgtatggtcgagcatccatggtgcatgattcttcttgcctggcactggcagatccttgtggggacgttcatcgggctgcagttcggcatgagcgggacgggcgacatctcggagcagtacgccatgtgcatcgtgctgttcgtgtgcgtgtacgtggccggcttcgcgtggtcgtgggggcccatggggtggctggtccccagcgagatctacccgctggccgtgcggtcggcggcgatgagcgtcacggtggccgtcaacatgttcttcacggccttcatcgggcagatcttcctcacgctgctctgccacctccgcttcggcctcttctacttcttcggcgcctgggtgctgctcatgacgctcttcatcgccatgctgctcccggagaccaagagcgtgcccgtcgaggagatggcgcacgtctggaagaagcactggttctggcgcaagttcgtcatcgacaccggcaacgacgcccgcaacgccgagatgaggaagaggatagcgctagagatgagctgatcatcgtcgtccatgcatgcagtctccatcgcccatgcatcatatatatgcagtaggcaggcaggcagatgaaggaaattacgtacacaagcgccaactaaaactaattaaacccaagtcaattacgtcatatatcactcaatagctgctagaacatatatgaatggttgttgtagactgatcgtaatcccagctagttatgatatacatcttgcattttaactagctagcgtatatatattgtacgggtgtctagatttttttatctgtttattctaacattcgagatctacatattttattttggccgtttcatcgtatgagatcttttgacaaattttaatggcaaattatgagaacttgctgagccatactattggggattcaaatgatttcacataaaaaagtcatcattatgaagttgtaccgtaggatgtgttcggtgaaagcaacaaatacacgatagaggtatcatgtagtttagactgtttccagtaaactgtgtaaattaggggacacagaactatatattaagttgtttgacactgttgtaaagacactacactaaaattttgaatttcctacggcctcgtaacttcctaaaggcagcaacaacctctcgtaggttctatagtctatagacttcttctaaagctgtcagaagtttgggaactttggacgggtgtctgtcagcgccgttggaagtgaggcttcagatttgaccgattaaatctattggagatgccttacggggcgtttggatccctccattttaaaggaattggaattcactcaataaagtaacttatttagtttggaatttggcattccaccactttccaaagttcagatataagcttatctcaaattcatagggtggaggataggaaatgattttatgcatgattagaatttgtttctaatctataacttatatgacactcttcgttctactcctctatagtaaaaatgtagcacataaatatgtaggacatcttgctaataatagtatacaaatatatttcatataaaagtgaattagcttaattgatatatgtctaaattactattattagaatggaattcaattccagtgatccaaacggggcgttatagaagtttgaaatagtggatgaaatagaagatgtaataggggatctgctagagataccttataaactttgggtttaaatatgttgggcaggtactaaaagtgttcgatccggtggtgcacgaaacatgtctgaggccctcgatttcaaccttccaagaagtaacaattggattttaatgtggatccataaatagaccacttgtctagccttggctgatatcctaacactccatacttttgtgagcacatcttgaggttagagaaacacacctcactcatttagtcgtttgcatcttgtaaatcatcatctaggtgatattagagagctcctagtgcatcaatatagttgttgcattctatgacgctagttgaacgacttgggtaggagttcatatgttcactgagtggctattggagattgttgttagctttgatcatcattatgaggggctcttgtgatcattccttaagagactttcgtgaagagtaactctagtgaaaatatggcctcttggagtgcctctttagtgtagttcttacggagccgtaattatgggcttggcgcgtgatgacaatttgcgtgtgaaccatctatcgatcttagacttgccacaatgaggatgaaggatgttggcaaacaaccgaacccttgagaatatatttgatgtcatttcttgtcccatttggcttgctaactatacttatatacttgtgttgtatttgctcaactagccttaaacttgtaataatttcatttgattaagcagattgcatcattcaatataaagctgaaggtcaagctactagaattgcgtagaggcttgcatacgatgaattgacgacagtgtaaagtggttgttgtaacactatttttgtactaatcaaacttttctctagtgtattatgagtttatatgttttttaggctatacatcctgttggagacttatccttaaatgttatgaattaagaacaaggcaacacagaaatcgttaaacgttaaaatccttcgtccttcgaagcattacttccctcgggatataatgagtcttggacgaaggttatgaaggacataccttcataagtacaattaataatgaaaaaaaattcacacgaagtataataacataaatacttaaatcttattattagctcgtccctatttttattattattatgtaaaaatagaaatgataacaaattacaaatgtaccttcggtttgagagaaggcaaaagtacaagcgtgacgcaaaagcaaaatgcccagtcagtgtgaacagtacgggagcactgttcatctatttataggcacgggacgcagcccatgtaaaattacactcatgccctttacatttgctaataactctataataatccatcgaggtctaaatagccttttctcctttaagttggttcccttttctgttatcacgctgaagctcccctgcgcgtaacttcggctctgcgccatccttcgtattctttgtgcttcttcacactgtaattttgacctaaacccgaaggtacctgttcatgtatcatactccagaaacattgttaaatcatatttttgaggaccttcggaagccgaaggcccccaacagtagcccctcgctatattaatttgttagaatgataaattcagattgcgatatggacgaaggccttacgccgaaggtccgaaaaaacatcttccctttgctagaatagcatcagtcaataacaaacggggccctcccatttgcaacgcactgggcgtataaataagagcacaccgcgagcacatctggcacactttcttgccatctgctcttgcttactcaacttttagctctttgcgcaccaacacttgcttagctttttaggttttttaagcttcggctttaagagcagttttttagcatttcggaagatgtctgaagataaaaaaactgttgccgaaacaaggctgagtctttctgaggagaaaaatcttgggtttcttgaatcaatagcaaagacaaatacagagaagatcactaaggagattttagaaggtttatctgaagacactggtgatagtgacagttatgatgtggaaagtggaggtgaggactccgaagatcgaccgtggcgaccaagtcacatagtcttcggaaaatcaactattaagcagagtcaccttgacaatatgagggggagatattttcgagatatatctactgtgagggcagatgacggggagaagactgtacctactcccgaagataatgaagtcgtgatcttccgaagcttcttcaaggctgggcttcagttccctctaatcagtttcgtggctgaggttttgaagatattccagatttttcttcaccagattactcccgaagccattataaggatgggagtcttcgtatgggctgtgaggagtcataacttggagtcgaatgctaaaagtttctgtagcatgcacgagcttctatatgagacgaagccctggggtaaagagcagtatcacaacaactttggctgctatagcttcgttgcccgctccgggtcaagctgccctgtgcccaccttccgaaagcgatggcccggggattggatgaaggaatggttctatgtgaaaaatgatttaaaggaacgagaggatattaaggagattatcatgcgccctatctggcaacgcttcggcctttggaagccgaaggtggaaattgatgaagcagtcgaagaatgccgaaaggccttcggcatagtctgctcgttcatcgggacaagggacttaattcaagagcatgtggcctacaggatatggccattggtagccaactgggagatgccaaaggaaactatcaacaacccccacgaaggtggtttggttcgactaaaatacaccttcagatttggagaccagtttgatgagccagacgatgattggctgaagagcgtcgaagctacaagtgatgaactgattgggtcgtactccaaaacagaagataatgcactatcagcggcctttggaagccggaaaacgaagagactcaaccgagttttcgatgctattgggttcatgtaccctgactaccgctacccgttacgggggcaaaaaagaaaaggtgcaacttccaggaaaggtgatgcttcagctgctccaagcgagcctgcgccgaagaggaaaaaggtgaaggtccttactcaccgaccgcgctttattgaaccagccatagtgcccgagtttgtcggtgagacctcttcggctactgaagccaaagaacctgcacttgcgcagaaaactgaagagctgactgcaacgtcgaaggctgaaaaaattgaagagccgagagctgaagggacaaaaacatcagaaattttaagtccttcgacaaaagtttaagtgccaaaaacctagaaaggtccagcgatgacccccaaaagaaaaatgatggttaatgttctagatgtactggagacaataaagtcttcaagctctactccaaggaaaattgccgaagctccaaaagcgcaaattgagacaacaacctctgaagccgaagctacaaagcaccaggctgagaccgaagctgggccttcagagcccgtcaaggagaaatccttggaaaccgaagaaaaagagacagaagcggcagagcaaattttggctgaaaaaactgccactgcccccccccccaaagcatttttcgaagctctcaattatattttacgacatgcttcggggaagaagttgactgaaaaagaaaagcgagaagctcagttctatgcccgaaaattgaaatatccaaagggggcattgattttcaacggtagcggagaagaaggcttcttgtattgtctcccagacagcaaggagatttctgtctgccgggagataagcaaaagctttggattcccgacactagaggacgggctctcggtgctatcaaaagatgaattagccgacagcttagcatacaatagcttaaaggtgaggaaatgaattttactgaaaagcaaaatttttccatttgtttatacttaataccgtattcctttttcagaaccttattcttagcaacgcccttagggcgcaaaaaagggctgaagacgtgggatgtaccatggcctagaacaaccttcgttccgaagtaatcaaactaaggaacgaaggtcttgagaaagataaaatattaaactcattgctaaataaaataaaagaagacgaagctacttccaaagcccaagccaaagcccaagctgaagcccagaagtgcaaaattgaagatcttcagaaacagctggctgaagagaagttaaagtgtgcaattgccgaagctgaccgagacgccagtaactattggaaaaattattgggagaagacagttgtagaacttcggtcttcaaaagagaaatgctacgaaaaatccatagaatgtgtgcaaaaaataaaatctagcttcgccaatgttggcgcattctctagcgaggataatttcgtaaggggcaatcctgaaggcccaattgactggatcaacaacgaagctgaagcctttgaagaagttttgagtggtcgtggggatgtctgcgccttctcaggtgccaggggaatcgcgactattttggagaaatcaggctgtgatcacgtgaaagctttgactcaaaccgaagctgccttatctattgaagatacaaaagacccctcggccgaagcaagcttagttggcgggaaattctttactgacatctgggagaatggcggccgagagatggcgcacgagataacaaaaaagagtgaaaaagattctcatgatgcaaaagaagtgacaaaggcatctgagaaagctgcggaacttgaaaggcgaataggtattgcttaataacttttaactttatgttttatttttatgacttcggacttatttacgttttctatcacagctgggctatctccttccctagagcccttcgatccaacggccgacccagaagcaaagagagagaggaagaaatcactaaaatggccgaagctattttggatgaagctatttctcgactgttaaacgaagctgcggaagtagttttaaaagaagaatagctgttattgtaaaaacacttggaatgtaatatttgctgaacaaagtgtgtagtatttttataattctgaatgtaatatataagctgcttgtaacttaattctttacgatgcatgaaactttacatacataccgtttttgaacctttcggcgaaaaaacaccttccattctttttgtgtttcgtgaagaatatccatatttcgtaaaaacatccaatctccataaaaacattatgcttcgtaagcaatagatctccttttcatatcggagttgacgaagctgtacttcttcaaaacttattttgtgctttggcactgcttcatcgaaacaatctccgaagattaacattgtatccccttcttgtgccattgatgcaatatgatgtatgatgttatgctatgcaaatgatgtgatgatgttatgctatgcaaaatgatatttgtgccgaagatacacacattaccacagtagagcacacaatctttttgccgtttatttttcggcttcatcgcttatttttcggtgtatcagcgctgacttttcgctgtaagcctcccttaggagcttcttcgccttttacttcggcggtattcgcgttgacttttcgtgctttgccttatacttcggtggaatcagcgtttatttttcgctgtaagctctgcattccctttggaacgacttttgagcagaaaacttacactgcgctctcttaggaacaactttttgtagtttcagcaaacttacattgcgttccatagaacgacttttttgtagcttcggatatactttttgtagccacgagctcttaagaactttttgtagccacgatttttttaggctatacatcccatctagctatttaggtcatatcattcgtttaggttatggtgatgtcctagagtcccaaaaaaacgaacttggttcaattaaatttctaaaaaatgtttgtaaatactaaaatacaaaacaattgaatgaccctacaacaagctgacggtaaaaatcaatcttcaccgtcggttcatatggcaagtcgatggtaacgaagagcacatcatcacgactaaatgtgtttggctatataacatgttaaggggttattttttttatctcaatccatgtggattggatgtgattgagacgccgttcgattgttacggattggtgggtcgaaacgatttctaaccggattgcttctctaatttacataaactttgattagggctcgttcgcttccacaggaataaacatggatttgttccagttcgtcaaaatctatataaattagagaagtaatccggctaggaatcaatccggagctccaatccctaacaaccgaacagggtcttagctggaacgattccgggtgtaatccggcacaaacaaacaaggtctgagtgagtttaaatttatagtaagtcaaaatctatcatattttttcccattcttatccaatccatatgccataacttggtatcgacatgataatttcagcacgcgttcttacatcacagagggggtggtaagtaatacaacctgctgctccgaaccacacctagtacacgtccgctaactttggcatgcagggagtacccaaaaaaggagctttacagtggagtggacacacccaaactgacgaccggccgtggcccgacgcgacacgagcagtcgatcgttcgagcaaaaaagcggagtggctggtgcaagcaagaaggcaagggagcagcagcgcactagtatttagtatggtacagcagcacgtcgtagtacaggtgcacgtcgtagtatgtaggtgtatatataggtacagtacagtccgtgcggggcggattgcaggcagagcaaaacgagcaacgccagcgggagagcccggcggtacggtggcctctcgccgcttcacttgggtccccagagcagcaggtgcatcaccttggccgtcttgccgtggccgtggaggtggtcctcgcgcccgcgccacggcgacgacgccgacgccgacgtgccggcccgcggcagccgaagctgctccgcggcgtcgcgcgccagcgcgcgcagcgtggccagctcgggccacctgctggcggtagtgctctcgctcccgctgctcatggccgccgccgccgccgcgcccgaccgcccgtagcctctaactaaacccgctctcggggctcgccacttctcgtcgccgccgtggcgccgttggcagatggacaccgagccggccggtttatatagccatccatcgtccacaggcgccggcccgccccgtcgtcgtgtaggggcccagtggactggactggactgcactgcacggcacaggtgagtggaggtgagacgcgacgacgataaatatcgcgtggcgttcagtgacgagaggacgtggatcgagtggccggggttacctggttgacgcactgcgcggccgatttttttttttttggccccggtcctgcggtaccgggcggcctcggcgtccgcgccacgcggacgcggtcgttcgctcacagtcacataccaggccgcccgtccgcccgcccgtccgtccggatcagtgacgaacggtcggtgagcatccacgagtggggtgggggatcggagtgccgccggttacgttcgccggcgggtggtcgcggtccgagacagggaggggtcgcaaggtattcaagtgcgtggggctcgctgccgaaagagagggttcgagactgctccggccggaagggaagggaacggaggaagtagtggctgcgcgccatcgctgcgtacttgtcgccgtggtgatggaagaagatggagggaaaaaatccgaccagcggtggtccaaaaggataaaaagatctcaatccagcgggaaaatatctcaagccccggcatttgccgacagtaccaaattcattgcacgtagctgtagctgttagttttaaagtgggtttcaccatattttgtttgatcaaaattaaacaaatcttaagggtcgtataataacatgtttgacaaatatcatcgatcggtttagctctcgagggatttgtacctgtgagggacatctggcagtgtgatctttatctcatcacatactgtatcttcttattcgtagcaggaacctttcgtgtcttttaagttcgcaagttcagtcatcgtcctctaaggactgaaccgtggcctgaaactagtcaggtttatttatttaatttatataacctttgatcaagtgtaactatctctagtgtatttctgtacaaacgaataagttctaaatgaaattaaagtgactctagggccggctccgataataattcacatgctctttgttcataacatcctaccatttttttagtctaatgtggagagtgtatagggtctgtttggttcagtttttttctgatcagcttttttgaaaatctggctgtggagagaatatggttgtggggagaatctgaatattattacaattacgtgtcgagaaagataaagttgttcataggtctcatgatctagaaagttacggattcctactattacaacgactcaaccgattatgcgtttatgttgattttggaaggtttttgccccaacgaattttatagaagctggctgaaaagctgagcgtttggcaatccgcaacagcttttggtggccagaagttgtcagaaaccgaaacaaacagggccatagtagtagaggtgagagatgtgctataggtctatatattgcagtgcttctagccaacgcattagacatggatagattaacaattcgatttttttcctaaagaggtgtggccagacgttaccagaggtgattatggatgtgctttattatgtacacaatgggtctgtttggttggtttctctcgccaacctggctgtgtgagccaggatcactggagtctggctctggagatgcgaccaatctgctcgtatctggtgagcctggcccaaggtgctttaaggatcgtgcgagtctggatccaaatctacatgcaagcaaccaaacacagagctcgcacgcgcatagcctggctcatagcaaccaaacagcagctacccgcatcccacgatgcaagcacgcgcagatgcaggcaaccaaacagacccaatgtgtcgtggggccagaaatactttgggatgccaacggaggtggataattaagcgaatgtcgcctttaaggtactagttcagctcaaaacaatcggtggatttgtgaatctttagaagacgtttaaacgagttattctatttattatttagatttaatttttttatagaattaattaaatttataatctaaactatagctccacgattgagttaggacttggaacagtcgcaaacatcaatcatctcaaagacatggttgtagattctagatgggtagaaggcgagttgaataaactataaagaaccttttgaagacacaagatactagagtagaactaattagtactccctccgtttctttttatttgggagggcttggggttcccctggcacgccggcgaggtggagtgggtgtggcccgcgcccgcccccggcgcctctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaacgaagcagatatctagagatcgacgtgctcgtgtgtccaggcccgagtttctcttcacgtcatccggaggaaaaatagatgtcgtcctccatctcataacaatataacacacatttgtatatataagttatcgagctattatatgatcccgttgcaacgcacgggcactgagctagtacatttcatatgttgaatgaaaaaaaacacgattcaaatcccccacaccatttccccgtctcatggccgccccttcttcctccaatctccaccattagagtaagcaacacaaaagtctcgatcgactgacgaggatggtggtgacagggtcctcaacgcacgacctaatttagcctagctcgagcacgacctgacccgttatccattggacctgtgtcggtccagcccgatcatcatgtcatgcctatgccttcgatgttgaacggggggctaagttcgatatgacctgatttatttttactctattttaaaaaacatatactatgctcgagtatagaacataaaacataaaaaaattaccatttgtgttcatatgtgttttgttggctagctatgtttgacttatgtttgactttatgtttggagtcaaacaaacatggtccaaaaacttaaaactttaattatcaataattacctcaatatgtaattgaaagacaccgtaacgacatgcatagattattcttaaaaggtatcttaatacttttcttttatttttttttacagaaacataccatagccaaagctgcactttagatatgacatctctatcaaaacccagaaatacggaatcgaagggagtgtatctctctgggtcaattcggcacaacaatgacagtaaaaaaaatctaaatcttatcatatttagctcaaagaagtataaaaaactgatgttaagcagtttattttactctattgtatacaatgagttaaagagtaaatacgaaaaaattgagaatcaaagaaaaatgttaatttaaagagaaatttgagataaacaaaaaaaatcaaaatgttaatttaatcaaagtaactgccgcgtgcacctgctggctgctgcggttgcggacggcattacctaaaccataccatagaccatcaatcacttctaacacttttcccgtctcccccttcctcgccgcctccactacagggctttgctcctcccaactctcgaaaccctacccacgcgatgagagatcgatcggtcgagcgcgaattccccagccgcgagcggggggatcggccgccgcccggggtgctgggtcccccgcgccgcgggccggcttacaagacgaagttgtgcgcgctgtggcagcgcggcggctgttcccgcgacacatgcagcttcgcgcacggacacgccgagctccgccggttccccggatcgcgcacctcgttcccaccccgcgccggtatacacagccttctctcgtgcccccattatcctctcgtacgcttttcttttcagtcgaatgtttaacctctgagatcgggatcccctggtggtgtagcgttcgttgtagatctggaggtctggttgtatgttcttttcctgcaaatcatgttcctcgtattgtttttattggtaggttttgttgtaagatgtcactaattctgcaccctaccgtgaatggttgctcatgtaatccatgtgatctatctgtttcggaagaacaacggtatgtgaccattcaatttatgagatgaagaagaaaggccatggtgcagcaaaaaaagggggatatttaactttttgccatctttatggatggccctaaaccaccagtcactgaccatctgtggagctacaaggggtgacatacatggacatggaaccacatgtgtctgggtatcaatgtccgatttaggtgtatgatttagcagattttttgaaatgccgaatagcacctgaattctgacacggtgtttataattatactggtgtcagtccgggtaactaatgtacctctggacatcgtggttcaaatggaactttattttttctccatgattttatagtagcatgttctctatgttttgtattaagtgctcgtgtgttttattaaattcgtgcttcaattcaacctcagttgctgcagatagaaaataattctcacaagtggaagcttgttgcagtctgcagaattaggcggcattcttactggttgccttttgatttaactaccattcaaattagcagactcctgagcagatttattagattcaactgctgccagaggataagatgacttttatatagattcttcagttggcatttcaacgatttattgtgacctgtaatgcttgtccctacatcaagaaggtgggcatatcagtatcttggatgatgactccactgaatgatgtccataatacatttgatgtgctatggtcatgtgcttagcagctttaacggttaattgcacatacccttgaatattgtgcatcagttagatcattgggaagtgttattctcactggtaattgcaagttattgtaattcttgcaagtcgccgcggaagatatctggacaaatgatagtagatttatattgtgatattgggattatagaagacatcaacttgtcataattgttatgtgatgttgttcatggtcttcatcaatttgattttcaacaatcaacattatgagtttggtatcatcttaatgggtatgtcagtggtttcataccatactttggtatctacccatggcattaatttttggctctactttgttgtggctaatgatattatcctggagacccttctacttattgtgcattgaattatcttatagctcaaaggctgtggtaaggttacaggcttatgggtgacctatctctattagttcatattgacacattttttgttcagcttcatttatccttttcttgtataaatttttctctatcctgacttctagggagaagagattatagaggtggtgactttagagataggtttgataggaggcgctcacctcataggaggcattcccctgatggagattccaggggccatcgctcccttcgtgaccgacgaccaaattcccaagaaaggggtaattatggccttattttaaatctggacctgacacttctattacattcaaattgaattccatgtccgttgcatataaattattaaaactgaaattttacttgcagaatctagctattcacggtctcccagtaggaagaggtatgcaattcatttaatatatgattaagtcattcatttgtaaatatgcttttacaaatgtaacacagctgtgtccactgctcaaattatcacttgtttatttattgtttcccattatctttttgttatcgccttatcggccttgtttacatgatgcaattttctcattactgttaattatgaagtcgcgaaagggcctctagccgagttggttaggtgacctgagtagcactcctcaggtcctaggttcgactccccgttggggcgaatttcgggctatggttaaaaaaccccctcgtctgtcccacgccaaagcacatgtgtaaggcccggtcgcggtcgtttctcacatgggctacggtgccgctgtgtatgggtggggcaggggtttggggttttctcgacctgtgtgagaaggtcttcttcttaatataatgcccgagggctatctaccccccctccccgcaggtcgatttttgtttttaaattatgaagtttggaactcaaataactaaaaatatttaacattgaatattatgttaaagcatcctctctgaaaccattattttcatatttttgcaaactcacagttgtggcatttattcaccatactattcactgtattggcatatgcatgtaagatgtgcccctagagaacatgcaagcacattttatgtcaacgattactaagttcatgatgtggtatctgtttgtggttatctaatgtgtccaattctaatgcacttcttaaaaaaacaaccaaatctgcttgttacaaatataattgcttattctgataaaatattctgaatagaataagttacatacctctgaactcttatcttactgattttttgggttcccaataaatatgtgaaatatggaacatattgatattgtagcttacttttccactctctctcagtgaaatgaggcatgataagaagcctgatgatggagaaactaactcatctaggagtctcagtgtctctgacaataatgatgatagaaaaaaggagacactgttaagtggtgatgataaagaggatcacgaaatacaggtgtgatgcattatacattttgtagctccacatcaccttttagcacacccttctgtgtaattgaaagcaagatttttctgcagctcaaacaaataagacaggacatggaacttttgcgtgatgataaatctctcttggaggttagttttgacagtctctattacactatcatatattgcatgctggtaaaccatgtcagtttttaggtgatgtttctatgggtaattcgtggtgtgcgtgtgtgtgtggttgggggggggggagggctctggatttcatgcatcggaacaatctaatatctttggtcagatttaggtgttctattttgttttgcactactatactggctaaaaaatggtgtatatagaacttggtaattgtaattgataacaattgtcttgtctattttttgttgtaagcttaaccattctgttcatattgtgggacaccgaccattcatcatcaatcatgctgtaattgcttagtttgatgatttcatttttgtgcttcactctccgtgctgattgaacggtagggcctggtgtagtggtgagagctgtctcactgagtcaccaggtcatgggttcgaagcagcctctccgcatttacggtgggaaggcttgcctcggtttatccttctctaggccactcatgtgggagctttcggcactgggtctgcttttctactctcagtgctgattgcaataactattctgtttgtatctttgttttaaacattttgatggagcaaggagcagtaatttgtagaagtttctgtgtgttccttgcttcgcaatgcctattgcctattatttcctccattccaaattgttagtcgttttggcttttctaggtacatggttttttatatccatttagatatacaacacatagtaaaacttatgaatctagaaaagccaaaacgacttacaatttggaacggagtactaggttatatcattagcataagcatttcttcttagtgtctttatttacatgctttatatgctgataatgtttcttttagtttctaattccttaaagtcatcattgacacatactcttttaactctgaatctgcacaattgaacatttatccgtattctgtgtaaattcagactcgatggtcgtattaactattccttctgtagataattttggatgagaagaatgctgaagtgcgcaagatttctagcagattaaatgatcttgatctgcagttaaggaaggagaaagaggaatgccacaggtacttgtacaatagggcgcctcttttgtttatacagtagctccatggtgtcttcaagtatataattatcatgttttttgtaaaattccaatgtaggatgacctcaaaaattaaaaagttccttaaagcccatgctcgctttttgaaagcacaggaagaattaaaaaggtacattgtgctttcatcacttttcagcttaacaatttggaaatcttttttgtcttgacttattgcatcagttcatgtttacatgattatgaattgatggctattattaagtaaatggaattgcgcaggtcacaagctcgttttgagagactcggtgatttacttgcttcagatattctgaagcgtggtgctaatgaagaagtttctagtatcaatgttgatgaagatccaaatgttccttatgaaaggagcccaaatgctgctatagctaagaagagatcaataccatactcaacaagtgaagaagcgaaagccggtgggtatagcttagtctgtctctgaagagtgtacagtgatgatgttggcttgaggttgacattagtatgatgtgaattgatcttaattagcatccgtttcttctatgcttgttgttaatgtattcatttcttggagtctaagcgagccttccctagcagctaatactttctcgtggaacttcaaacaatagggttgacatgattagttggctacccttttttagaaacactgaatgaagtgtccccttcatttgaaagtatgatattttagaatgtgactacttctaaagtataacatctgaccttgtcttgtccaaatgaataatatattctttgacaagggagagtttttttttccatttacgatctcagcaacatttgttgccgtgtttaagatgtcttattaattgtgtactcatgtttaatcttgtccttttcagtgaagaaaagaagagagcgggactctgacacaactaggccagataaatataggtttgaaggtactattgcaggatttgaaaaactaagcaagggaaccgagccaacaaaatctttatatttgaagaagaaactgtgggaagatgaaaaggataagataggcaactttgtctcctcagccaacaccgacaaggtgcaatatttttcacgtgctaactcaattttatgatattatctatatcatgttgtcactgctggctggtttaacatggacaacatcctatctttgtgcatatgtttgaggtcgaccctcattgctctgttacctcttgcttactcattaaaacatcttaacaattgggtagcgatatataaaattgtgtagccttcctttgtcctcggtcctattagctcatcatgaccgttgttgacatgattcggactgtgcgtagtatgagctgaaacttttattgagtagataattttaaacttacaggtcaaagaatctccggtcaaacatgttttgccctccactggtatggctgctcatgctttggacgatctgtttgaagctgttgaactggaggatagacgtgacacatcaatagaaaatgatgctgatgacgaaactaggtcgcctgttatgcccccacaaccaccaccggtggttaatacttacgagcaggtgactaaccttgcatcctatgtccttcgaagaacagagtaaaaaaatggatttgcgtcctgttgaaaatgacaaaccttgcacttgcgaccagattgcctagttcctcattttcttctgttgatctgctacaacatgctcacagtttgttttgtttgtttcctagtacgaggctgatgacgaggaagtcgacgtggaatgattagaatgccgagatggtactggaatgagctatatagctctcgcgcctgtgtaaagcattatgtaatatgtatttgatgctggagtttaccttgcataaaaagaatcgtcattaatgatccttggtggatgcggtttaagcactcaacttttttgttaatttgatgaaggcaacatgccctgttacctgtacctaatataccacgtggtggctagctagccagccttgtcagtgccctggtacttttgggtggtcttgctgtgctgttcgcggcacttgaaaactgatgttttgtaggactgatgttttgtaggagtattatttgaatggtagccgttgatcttcggctgttgatgcgctgcttggtggcattggatgtgatgcattggcaggtttacattgggcgtgattggttgactgtacagagacaaccgacgtgagatcgtagttggttgcttgtacatgagaatgtcggtctgcatacgcgtgtgctctaggcttttctcaaccaatcatacctattgtattgtgttaggactcgtgggtgtcaaatctcatcgcacctgcttacttgaatcatcatctatcattcatgagtcacaacatttgcaaatgccttccagcaggctaatgtctcagccacaagagcatcaagtatgtccagcaacttgcccgcccctgcgccaacacactgtctcttctgtgatcacgagacacaaaaccccacccatgctgttagcttggacaaaggaaccatcaatattaatcttcaacaaaccagatgtaggagatacacctatctgccagcatttttgagaaaaaaaacaatgcccaccatcttcaacgaatcaccacttaaaaaccgggaaggtagtgctagtgccagtccaaacaattctattaagtctctaacaaaaggagcaagagggtaacaatttctttgacatgataattgcacccgagcgtgaagcacccaaaatgcaagagcaaaatcacagtattcgctagcagtaatggccatgaagggaaagaagaagaaaggcaagaagctacatgcattagccgccgttgacgacagcgcagttcctcctgacctccccctcggcgccggtcttgacctgcagcgccgccagcctggccatggaccgcgcgaacagctggaagaagacctcctcgggcccggccgcgacgccctcgacgtcggcgcgcgccgccgcgtcggtgagcagcgcggcgtcggagcggagcaggcccgtgcgcttgagcagcgcgcggtagtagcccaggtcgaacgtcaggtggctgcctgggtccatctccaccacgccgtcctccgcgtacccgccgcccgccgcccggcacttgcgcctccgcaggttggccgcgtaggtcgcgtccagggccgggtcggccgtgtcgttgccggccgcgccaacgccgccgccggggtagccgtacaggcggtccgcgaaggaggagcagtgcgcgatgccgatcgtgtgcgcgcctggtcgcgatcagtggcatggcattcaactccacgtgttagaaaacagttggcggtggacgactgcatgcgcgtgcaaagactagctagatagagaacggcctctgcacttgcgtggaagatttattgaacacttgtttctatgcctttttttttggcagctgggtttctttcaagttgctgatgaacagcttgatttcttggagcaaaaagaaaaaaaaggtttttaaagtaggttttttaagttgcgcagttttggtggtgtgctactgtgctcacttatatccttaatcgtgttttttctcagctgtgtccttctgttctatagcactggaagagcataactgagcaaaaaaacacgactaagggcataagtgagcacaccaccaaaactaaggataccaattttaaaaacccaaaaaaattaaggtcgtgtttttttgctcagctgtgcacttccagtgctatagaacagaaagacacaactaagtaaaaaaacacgactaagagtataggtgagcacaccaccgccaaaactaaggacaccaatttaaaaaacccaaaaaaaaagtcaaaatgaacaagctaatgcagtatgacctctgacctatgcgcgcgcgcacacacgcacacacaaaattcaggcgctgcactgtttttcttttgtgaaaaaaaagagagctaaattcaagaacctcatttcagaggaatcagaaacggtcagtgctcaactaatatgaaattatacagtgaaaagaaatgtttttttaggactgaaaggattttttttcccggccaggctattgaattcagcatctgatgcaagacgcccatcattcgtgctcgaggaatctgtttataggagtggcagcgaaagcgtccattattcgtgctgcttttgcacgcactgctgttgcccaatcagcatgcaaggaatgggcaagcagaaccaggctctctcagctcagtgtccggcctacgcctcgatctctccagactcaagagttaccaagccggccggctttttgtttttttaatctccctctccgatcgaacttttgtgaaactcacgtttgatctagtggcaggaataatccctaattttttttactgatatgtacttaagcatgccttttttaagggtttttttataagagcaccaatttaaaaaaacctttttttaactgatctaattagggatggcaacggggaattccccgtcgggttttagctcctcaaacccgtccccgcgacaaaaaaaattccccgcggggatccccacgaacgcttgcgagggacatttcttccccatccccgttcccgcgaggataaatccccgtcggggatccccatccccgcttaaattataattaaatcgtatttcatttgttattaatgtaaaatattgtcacttatacacattgttaaatgtaaaattcattatgtgcacattaaaatcaatgtatttgtacaacgggtgatctcttgacaagataattctttacttttatcattaactattacataaaaatattgtcacatgtaagtttaacgggttcccgcggggaacggggatgaggaatgcttcttcatccccgtccccgtttacccgtcgggggagaacttttccccatttacatccccatggggaaagaaactttcccatccccatcccctaatagaggaattccccgcgggaaatcggggatcgggtccccattgccatctctagatctaatcatgtagaggagagggtaccgtaccgtacctgagagccagacgaggtcacgaacgccgaggcctttgctggcgaacaggctggccagctgcgggaaggtcatggtgtgcttggggatgtcgtcgagcgcctcctgcatggcggacaccgtgccgtccctcctccccgtcgccacgcgccacgacggcccgccctgccagagcccagagcacgcactcagttgtcagctcgtactcgtacgtacgtacgtacgtgcatggtcgacgacgatccatccatcgtccaggcaccaccagatcgagaagtggcgtggtggaaagtggagtgacgagctagctcacgcacgatggcgacgaccgcgtcccgggcggcgagcgcgaggacgtcggcgcaggagacgacgccggggcaggcatcctcgacgagcgccttgacgcggtcgacgaggtcgaagccgcgcagcgtcaggttcggcggcgcgtccttctcggccacgctgccggcggtggagttgagcaggacggaggcgtcgcagccctgctgggacgagcgagcgcgtggtgggacacatcacacacatgcacacacccgcggtcaggctggcaccacgccacgcaatggacgacgcacacgctgacacgcacacgcacgcacgcacgtaccctgacgaagcagtcgtggaagtgcagccggagcaacgcggcggcgacggtgggcacgcggcggacgtgctgccggacgaagtcgcccaccacgcgctccacgcccgggcagctctcggcgtagaaccccatcctgagctgcccggccgcgccggcgctggcggccaggacgacgagcaccatggccactccaagaaccaccggcgccgccggcactacggccatcctcctgctgctgtgcctctgtgtacactagcagccgtgtgtgtgtgtggcgaagaagagacgagtacgagtgtacacaggtctgtggactgggacgagacgatggtctataaatacatggaatgttttctttgttttgcgttgggcctacatacacacacacacacacactccagatcgagcttgcttaactaacacactgacatttgcagagctaatagcctaatactgatcgaattgttcagataaaaaaaaggggattcgatagggtttcttgcagcagcagctagcagcagtagagatcgaatcgagctatgatggtagaggccgcaagctgcatcccggttaagtttcgcagcgctttcacccgcccactcctagctagtcctagccaggcagcacgtgtgcgtgtgtgcccaccaggaatgcgattcgtgcggtctcttttgcagtcctcaccgtccatggttgcggttgttgaggttgaggcatcggcgtcggcgtctgcagtgggtggaagaaagagcaagaaaagaacatgatcctttcctttcctttcctgccatggcctcaaagccccccctagctcgctagctggctggccccggcctcttctgcgcaactttcagcggctcatcatcgcctctttcaggtcatcatcttcttaattaattaattcgctgcactgttctcgtttccatgcggcgtatacgtcaccgacgcacaatcgtcactcttctgtgcgtgggccggtcttgtgatgagactggtcgatcaacgggctctgtcgtggagaaagagtgagccgatcaaaaagcgaagatctccttcaggcatcctctcggttcttgggccacgcgctgtatgcagcagctcctcttttaccgagaggggatggaagctgtgactgtgaggtaggcaaagcatgcgcaattgcgcatcacctgcggctgcgtgcactcggctgatgagcaggcagcagctggtcaccaccttgcagccaatttttctcgagaaaacatgaagccatagcctgccctccaattcagccaccagaaagaaatacaatcctacgcgatattttggatttagcaagaaccagcgatcagaacccagtagcgctgcaacgaagtgtaagccggactaaaggaccgagcttttcagatcctgtagctagctaatagcattcagtgaactgaagttttagctagtaagaaacgggaggtctgatggaatcatttttttgaagtaaaaattactgtaggggggcctacagtgtctgatggaatcatggaataccagctagacaagttcttgcgtctaccgaggaacctggggcgtctctgcccaggaacgacacttggatgtctaatgaaacacaaacaccagctgaacaaatctgtcctcacgaatctggatgtctgatgaacaccagctgaagaaatctatcctcacgcaacatcaagagaaataaccggaaacagccctatttagcagacttttaactgacagcttattcataatttaatggtgtatttggtggcaatgacggatgagacgatctcgtagagttcaggatcagaggttataatataaccatctcagtgccgtctatagctatccatcagaattagacggaaacgtcgtggtcccagctatcccgcaaccaaacacacaagacatcacaacggttacggatagaacacgagtacaaccggtccattaaaccgaagtcaccaagagttaagagaaccctgtatacttcagttgatgtgatcaagttgctgtcttgcattgtatgccctgcttccagggaccatagagctttcaaaggaattattatgattatggtcacaggaacactagagcatcgagaaaatttaaccttgaagaaaaaacctaactactccttagctagaaggcatcctttcatagtaataacctggatcgcttaaatagataatatggctgtgcacatgatcttttggattcatcaagaactacccagaacccaataacaaagcagcaaaaccaaaagtcaaacatgttatgctgtaagccagagtaaaaaactgagcttgacaaaaccaagttaacattcaacaaaccaaacacgttaagctgtaagccatagtgggaaactgagcctgacagaatcaagttaacattcagcaagaaacggtagaaagcaagaacctggaggggtccaataaacaccagcgaatcaaatttgatcccaggcagttaattaggagatataaccagaaaaaaacataatgagcagacttttaagttcaaatatcaaacttcataaggattcaagccatactgctgcagaagagttttgggtacaacacagaggacacaacaggtccattaaaccaacgaagccacaaccacgattcatgacacacaaaccacagatgtttattagacgacgacatccatatagaggtacaccagagggcaccagacgacgcagatacccaggtacagcagcagcttaaatgaaccatggcttactgaccaccgcggaggcggagcaccaggtggagagtgctctccttctggatgttgtagtctgctagggtgcggccatcctccagctgcttgccggcgaagatcagacgctgctggtctggggggatgccctctttgtcctggatcttcgccttcacgttgtcgatggtgtcggagctctcaacctccagggttatggtcttgccagtcaaggtcttcacaaagatctgcataccacctcgcaagcggagcaccaggtggagggtgctctccttctggatgttgtagtcggcgagggtacggccatcctccagctgcttgccagcaaagatcaggcgctgctggtccggtggaatgccctccttgtcctggatcttggctttgacattatcgattgtgtcagacgactccacctccaaggtgatggtcttgccagtcaatgtcttcacaaagatctgcatgccacccctgaggcggagcaccaagtggagggtgctctccttctggatgttgtagtcagccaaggtgcgaccatcctccagctgcttgccggcgaagatcagccgctgctggtccggtggaatgccctccttgtcctggatcttggccttgacgttgtcaatggtgtctgaggactccacctcaagggtgatcgtcttgccagtaagagtcttcacgaagatctgcatgccacccctgagacgcagcaccaagtggagggtgctctccttctggatgttgtaatctgcaagggtacggccatcctccagctgcttgccagcaaagatgagccgctgctggtccggtggaatgccctccttgtcctggatcttggccttgacattgtcgatggtgtccgaggactccacctcaagggtgatcgtcttgccagtaagtgtcttcacgaagatctgcatgccacccctgagacgcagcaccaagtggagggtgctctccttctgaatgttgtagtcggcaagcgtgcgcccgtcctcgagctgcttgccggcaaaaatgagccgctgctggtccggagggatgccctccttgtcctggatcttggccttgacattgtcaatggtatcagaagactcgacctcaagggtgatagtcttgccagtcagagtcttcacgaagatctgcatgccgcccctgagacgcaacaccaagtggagggtgctctccttctgaatgttgtagtcggccagcgtgcgcccgtcctcgagctgcttgccagcaaaaatgagccgctgctggtccggagggatgccctccttgtcctggatcttggccttgacgttgtcgatggtgtcagaagactccacctcgagggtgatagtctttccagtgagggtcttgacgaagatctgcatgcctcccctgaggcggagaacaaggtggagggtgctctccttctggatgttgtagtcggcaagtgtgcgcccgtcctcgagctgcttgccagcgaagatgagccgctgctggtccgggggaatgccttccttgtcctggatcttggccttgacgttgtcaatggtgtcagaggactccacctcgagggtgatagtctttccagtgagagtcttgacgaagatctgcatctgcataagaatcaccaaacaacagggtgactatcaacaaaaaagaacagtctcaaaggaaataaacagcatatgaactatgaaggcgccatgcatgctcatcacactgggtattcaaaatctacacatagctgcagcatatgccaccatacaagtacatcaaaatcataataattagaagacatactgatatattagaatatataggtattcacgaatgattaaacagtagcagcatgtgcatgctatatgatgtatctaaacatgttaagtaccagtaatatcaaaataattaaaaacatactgatttattagaatatataggtactcaagaatgattaaaccgtagtagcatgttacttcatgtatctaagcatgttcgagcatgtatatatacatctatctaagtaccagtaaaatcaaaataattaaaaacatactgatttattagaatatataggtactcaagaacgattaaatcatagtagcatgttacttcatgtatctaagcatgtatatacatctatctaagtaccagtaaaatcaagataatttaagacatactgatttattagaatatataggtactcaagaacgattaaaccgtagtagcatgttacttcatgtatctaagcatgttcgagcatgtatatatacatctatctaagtaccagtaaaatcgaaataatttaaaacatactgatttattagaatatataggtactcaagaacaattaaccatagtagcatgttacttcacgtatctaagcatgttcgagcatgtatatatacatatatctaagtaccagtaaaatcaaaacaattgaaaacatactgatttattagaatatataggtactcaataatgattaaaccgtagtagcatgttacttcatgtatctaagcatgtttgagcatgtatatacatctatctaagtaccagtaaaatcaaaataatttaagacatactgatttattataatatatatgtagcatgttacttcatgtatctaagcatgttcgagcatgtatatatacatctatctaagtaccagtaaaatcgaaataatttaaaacatactgatttattagaatatataggtattcaagaacaattaaaccgtagtagcatgttacttcatgtatctaagcatgtatatatacatctatctaagtaccagtaaaatcgaaataatttaaaacatactgatttattagaatatataggtactcaagaacaattaaaccgtagtagcatattacttcatgtatctaagcatgtttgagcatgtatatatacatctatctaagtaccagtaaaatcaaaataatttaaaacatactgatttattagaatatataggcactcaataatgactaaaccgtagcagcatgttacttcatgtatctaagcatgtttgagcatgtatatatacatctatctaagtaccagtaaaatcaaaataatttaaaacatactgatttattagaatatataggtactcaataatgattaaaggaactgtaggagcatgttacttcatgtatctaagcatgtatatacatctatctaagtaccagtaaaaatcaactcaagaattattaaaccgtagcagcatgttacttcatgtatctaagcatgttagatcatgtatatgcatctatcgaagtaccagtaaaacccacagcaacaagtatacccgtccttatctaaaggattgatatttccatgcataatcttaactacgaagatatatgtcacacatacagatgcatcatctcaactacgaagatatatgtcacacatacagatccaaatctaatagatccgcatgtcacacatacagatgcatcatcttaactacgaagatatatgtcacacatgcagatccaaatctaatagatccgctagacagtttgaaacagcactctactccgatctagaacgacagcccgaccagaccacatcgccacaaccaaaccatacaaaaaaggcaaggtaaaaatgacccggcaaacaagcgcacagaacgtaagcagcacggtcgaaccgtatcaacatcgtaccagaatatatggaaataaagaataacgcggatcgatcgaacgaaaccctaggcaacgaaacaaagaaaaaaatagagaatcatgaaatcggtcccgtctgcgtgcggggccggctacagccatcccaggattcccaggtactggcgagttagctagcaatcagaacgcgtctggtgtgtacagatcgcgtccatgcacggatctaacgcaaacatgaacatagttagcaggccctaaccaagtaaccatggatcggatcgccgatctagagaaggcagagagagaggggggggggggggggggaggatggtcgccgtaccttggatcgacgaggggatcggggatcggagatcggagaccgggcggtgtgtgcgttccgagcaaaaggagagaagatgaggttggggaaagaagctggggatggggctggctatttatgacggcgggcgaggaagggggatgggttgggaacgagtggttgggaaggaccgcgctggctgccggatgccggtgccgtgacgtttgagaggagctggaggacccggcctcgtctccgtccactctgccacgcaacttccggatgccgacagcggaaagcgaaaccaccacgctaccgcgggaaggtgggggcggaactctcgagaggcagccagagagatgccgcgccgtgccgtatgcagtctgcttcactcggcggcgcggccggcgctggttcctggttgtggttggtgtccgttagacttctcaacgccgttaaacgggctcacgcctccgcacacactagagggaggaaaatgaatttttttaaaatactataaagccggatggaaatggcgcctttgagcctatccacgtcactccaaaaattcgtagccgttggatcgtggatccttggctgactttactcatctgttctcctgtgcgcacctcgcctctggagacttctaccgagtgcttacgctgtgcctcactcgtgttttgctctatcttctctccgcctgctcttgctctgttttctcctcctcctcgtttcctccgtctagtgcatctgcaggttgcattgcccggtttggtccggcttcctcctacgactggatcctcggctgctgctgcctcgtcgccggcgtcaccgtcttcgcgctcgtcaccgtcctgcaggccgccacgctcgccgccttccccgcgctgctcaccatgtgctgcgccacctccgcgacgggtgcctctctcaccgccgtcctgcggctcgtcctggaagggaggttcctcggcatggggtcgcccaggatcgacgccacgcttgtcgcggggatcgtcgtcctcggcggggccgcggttggcgcgtgcatggcgttccaagcgtggtgcctgggcaggaagggcccgctgttcgtctccgtcttcgggcccgtccagaccgtctgcaccgccatcctctccgcggctctcctccgccaagtcctcagcctgggaaggtatatatgtatgctctgttgtgcataaaaaaagaagaagacagcatgctgtttcactgaatgttaatgtattctttataccttccgactttcttttctgtcctccttttgttttactgaagttggtttcgatttcatgctttttctcgagtttctttatctcgggttttttggtttccaatcccactcggttttgctcaacatggtttggattttcagtttttccctgaagaaaaaaaggatgctccatgttccctattgttcaatctaatctctggttcttgtgctttagatcttctaaatcttcgcccctttttacccctctccttttcctggcaaatcattcacatgatactttcctatcgtccgaatctgggttggtttccactgcatacttttcctgcagtttgcttattcgttgttttggttttccaatctcattctatgtaacatacatcattgatgaattagacagtgtgtttatgtgtaaccgtatataatgtttgtcttacaattcatgatgttgtatcaatcccaatctgtttttattacacacagttttgggtaaaacaaaacatacaacattgataaattagatagtgtgtttatgtgtgaaacttaattaggataatcttattacttctagcttgtgtttaactctctaaatgtcccttttctgtcgtccttagagcaactccaaccataagccttatagttaggctctataatttaatttactacctattctatttgttttatggttcaaattcaattgtcaattccaatcatggaccctaaaatggcttacgtttgcaactacctcatgttcctgtacgtagtcctctctgtttctctcccactttgcacgtcattcccgcctagcttttttccggttgcttccagaaaatcgtcaagccctcattagcgcctgcgaccgtggggatggcagacttcaatccatcaagcacctagcagatcaaggggaggggagatgtgagataatagacaagagcctagcaaatcaagagaggagctgggagacaaaccacggggaagcaggatgatggagagaaggcgagcaagatggaaaggggacgatcgtcttcctcggtggctcgtcaccgagaaacgaatggggtgacccagagatgagattggggtggacgcgtcggtctggatcggtggcggcgaggaagttgtctccgtgaaatatctagtggaggttggaaataccgcgaacattattgggccgcgcgtttgtgagtcccaaatataatactctttagcttgagccccaaaacatttaaatgaattttattaaaatgaggctcctattggagctcacctttcttgtttaggccttatatttcaatttgttttattgcttagggctattgttggagttactcttatattttactcaaacacgtttccatccgatatctgatacgtctcctacattttcattatgccttcttttggatttccaaccccactatgttgtgctgcacataatttgcattgccagttcctcctcaagatcaatttttcctcgtgttttacatgtaaaaatgtataagttttctcagatcggctcctatagccagtggacagtatagtcagcatgcaggctaatacacggaggtatgcttttatacaaacctagatcatccttcctataatgttttattaatgtgttactaccgatgtgcgtaaaacttaattctttgttctaaatacattgctagaacctttgttgttccaaaaaggaagcaatttggaactaaacacattgaacattacgtgtaacccttgcaaatctgtttagcgaggtaagtaatgctaattttaatctttttcaattcatgttgttcctccactgcactatgagtgaagattatgcaattgcatttttcacactgaatttgtgtgctacacatgttttaggttcttctaattcatgctttttggtgggatcgagcaagtgaaacaatacctctgagcctcagtgacttcatcgacgaggtacttgacacaaacttttacagatcattcatgcgtagttgtagagtttttacagtttcattctgttaccttagcttacgtgtttgacacactttgattctttcttgttttcctataactatgtaaaacattcatcgttttattttccaatcattttaagtaatttgatcctaggattcttagcaatgtgcatgtgcctatgtgttttagcaacaagttaggtatcatatagtgtagcttatctgtcatccacgtcttttacctctattacatcatgcacgattggtacattaaagtttgattttgtgggccacaatcatatttttctatgcaatagagcctatgctcaatataattatgtatttttagaaaagtgcaggttcataacctaaatacatctgaaattgatagaaacattgtgataagcaagtttataacttctaatatgagatggagcgttctaatccaaacaatacaaagaaaagaagtaagtatttttggtactgtcgttagacacatcaccagaatctaagtggggaaaagggtttcgaacatggattagaatatgttgataaatttatattggcagagcaaggcaatgcatgttgtgccccatcatctatgactcctagtgaagctcgtcgcatccgtgacatcctgcaagttcagatctgaccgccattgtatctttgaaatttaccttcacagatactattaacatgtcagcattctcagtgacaaacaaagtcttctctattctctctttgttaacaagtcatgggaggcaagcctcggtaccatctatcatgctgaactaccctcaacaacagctactgaaacaagatgatgaattcggatctatagccacacaagattctcccgcgacatcgtttgctatgttatcaacttctacaaaacaggaaaacaaggtataaaactcctcactgaatataatatacatcttctataaaccatcctacagatatataaaccaatataatgcatttgacaggtttgacgcgttttagagtattccgttgcatcgcacaatgcagaggtattttcgatatacttttatgtctagcttctatacattcagaaaaacagaaacccatgtattgtcaagacatccagtttagatggtaaacaggattgctaataagataagcatgtgtacaatttattaatataaataaaatgctctccaggtttgattcaccagcattaactaacacaatagattctcttactcccagattgttgacaaacatgatgatgagcttacgaacaatgatttgccatcgccaccaaagaagtacgtaacagaataaattcatccgtgaaccgaaaacaagacatgtctctcagctctacatatactaatacaatgtggcacgtgcaggataaagcacatccaggctagcaacaaaggcaaaccagattctacatacatgtccccaaaaatgaagctagccatgccatcctcataaaaatgaaggtataacaacatttaagacgcttcgtatacacttctcctgttatctctagcaaacgtttttaagcgcaactaacctactctcatctatacacaggtttcggtttctgcaagcataagaagagcttcgtcacttttggatttcaacgacttttgtctacatatatagacaaccctgttgttgaaaccttcccaaaactatgcttgtttatgcaaactttttagacaaaatattactggatgtagaagtacaatatattgcaacttggtacgtactgtgacctatttctcttataactctacactctttggtttcctatattggatcttggaatacgccatataaacatggacattacatcatgtttttgacaatttattaaaacatgattaaaaagacacaaaggatgcttagtctaattacatagacggtctttaattctcatcaaacaactatttataacaaccattctccatattacaaaaaatgtagcaataggaaaaaggaaaaaaagtgatacgtaccaatatagtttgtttagaactgagcttattcccaaataattatgtaacacgaaatgactgctgtaactacttatatacaatttgctttaagtaaaccatgaaaaaaaagcccaaccacgcgcgcatgggcgcgcgtaacgcactagtactatatataaaaaacactacttttaaccatcgtaccgcgtcaatattccccttaaactattcgcaacggttttctctattttttttctcctatatatcatttttatgtcacatcattaacatttcacactctacctttttatctctcatggcggtttcccctacccactacaactaaaaccattttttctccacctattaaaaaactaacatacacattaacacctattaagaaactaacatacacatgaacagtgaaagcggagcagacgccctcacactacctgtggcagtttcctattcacttgcgccagctagagggcctcgcaggaggccacgctgcgggcgtggaggcgcttctgtagccgccatgcaagaggaggggacgaccgtgcggcgagcgtcgcggacaaccttagaaaccttagagcttgttcgaatgcgtctggatctaggtgaattaaaacagtaagagattaccaaccccattcgatcgagacacgtaataccttaatacaaaataaaataaaattatgtataaataggagttttgatattgattgttagctctatattcatatctaactaaccgatagagtatacacatttttgttctttattataataaagcctattatataatatatagaaactatattaatgtgtggacaattaactagttaacgtataacgtgagagcacacgcaagcaacattttcaccggtccttggctccttgctccccgccgtgggccccactgaagagtggtggggaagtggggtagtgcggggcccacgtaatttaaagccgtctgcgtcgaggtggccatccacgcgcgccatcatgcaccgcgccttgattaagaggctatatagagagttgtaattatttagaatgcactataaaagacgagaagtatttttgtttcgaagataaaatttaggaaacattgtttaaaaataggacgagttttttgatgggacgtgaatggatttttttcacgcagcacaatgatgttttttttgaattggacggcaccattatatttatttgggaggcctaattattttgcgttattcgaactttatgggctgcataattggtgggtggtagggtagctagtggtttgccaacgcatcagagaaacactgccttttgcttttgtgcagttgtgcctcacaaattcctcggttttggagcaaactgtgatcgacaccctctctactagtggaagcagacacataatcaaatcaactgctgattgcgacagcaggcgtttggcaatcgagtccctcgcttgttaatttgtttattattcatctatttgctctgaaatctaactacaagcctatttgattgattttaaactgtgtcggtgtctaccgtttctataacgtgttttgtctctataaattacagctacagtagtctaaatagctgactttaatacgaagcgaacgctgctgttcggatgcttacaatcagtttcctcgtgctgttggtgctgatgctggtagggtattgtctctgcccttctgctttgttcgtttctggcgtcgctgaactgtttgattcaactttctgagatagattcgctcttaaaagtaagaatctcaatcaaccaaataagtacaagagtatattaactttctcgcaacttatagataattagtttttttaagaatatacatctaaaccaaacaagcagatcatctaagactagctccaacaagaacctctaaaggttattgtaccctaaatttagagaacgctgctggatcatctatatatagagtttctgtaaacggttctttatctatttgaatgctttaaacaactggtttagcaaaactaaaatatgtataatacatttgagagtatgacaaatacatatgtacaaaaaattaaaaatttaaaaaatgtctttaatatagatatttgcctatagaggacatgatttggagaatgctgttggagagaaaggagatataggagataaaatcttttagaggagactgtaaaagacaaatatagatgatagatatagaagacgttgttgaagaccgtctaacccatacattttgctttcctaaagagagcaagtatatacatctatttactcctttttgtaagaaaagaagaaactatgaccttgtttgtttcagattttttatgcttctgatcaccagaagctgctgcagactatcaaacgttcaatttttcagcccgtttttatgagaatcactttagttaaaatcgttcaaaattaacgtgaacacagaatcgaccgggtaggaaactatcactttctacattataaatcctatagactattttatctttctccgtatgtaatctccacgatactaaaatcaactgcacaatcagattctctctatagccagattcatagaatagttcccaaaaaactgaaccaatcaagtcctatgagtgccacggatacgaatcctcccctattttatttcgttgtagtttctatgcattacttggacctcgtcataactcataatttgccccagcgtcttatcctctatcttatttactattttcaaaattttgcaaatattattaaacaatgttatctacaaatccgtgtcttctattttacactacccggatacggtctcatcttgaaataagctgacatgttattgtactcttcattgtgaactaggtgagtgcccgtgcgttgcaacggaaccatataataacacgataacttatgtatatatgtattatattgttatagtacgatgcccgtgcgttacgacgacatataaattatttgataaaatgtttgtgcacaatgattacatgaaagcaaacaacacatatattatcatcgacttcaatatctcataaatttcacaaattgtgtcaacaaccaatctctactataaagcatcaatttacacatgctttggtgggactctaaagtcatgttcacaatcagaatatcataacctaaagtccaattcttatggtgacccgtagtacaaagctacaaaagagaatcaaatgcaggtacaatctcaagaagaatgtggtccttgacgatgacataagcaaaactgtttttaacatagcttacctatatgtagagaaaaatacatagtataaagcttccataaacaagagcagagtatatctccacaagtgatcataattggagggttaaatataccgaacctgacacaaaactttcttcgtgttagcacgtttaattgtggacaaataacacatcgacagacacaatttaagagggtcaacaccccaatttggaaaggaaattggagggataaagtaaactcgattagttcctatgcttatatataacaaaaggatacatagaaatgcaagcaaagttgagaatatcaaaaggatagaaaaactacaagcgcatatacaaggattatcagtttgatggccataagatcgaaggttccagaaccttattttgttctatttataggactgatgaatagccaagatgtgtggtagagcgttgatagcaggtaaatcacaggatgccatcatttattcatttcatgcatgcccttcaacatctcttgaagaggaagagaaatggaaccaagttaaaattacacgaacaacaggttgactaacgaaaaaggatagtcttaccaccacaaaccaaggttaagttatcaaggtccaatatagtatactcagttgatcttctatgtttgtctagctgctagtacttattcaattattatttctcttcattaagttctctcagtctttcctctaagtagtggagacaatttgaccaatctgcttccctttgttggcttcttgtaagtaaggaattgtcgtctcaacatgttactctgatatttgttaagatttattaagaattgtggatattcaaagtttcaaactacttgttttggtcattattttcaagctctccttccgtctatcctcaaatacgtgtgtcaccagtctctttgggatgatctaattgttcagaatctttcatcaaggtaaaggatgcaatctactattggcaaatgtgtccacgtaatatctgaacagattgaatacatgaataggtaaatggtgagtacttgttacctttccttgctagacaacgtagtatggattaccaatgagagaaaccggtactgggagtgaaactgttggcaaagaatgaaaacattagattcacccatggatttcagcaaagtctgttagtaagctcgtacacataagagtaataaaagtacatacgtgatgccaagacatcaacagttcttcaggcgagcaatgctcacacttgcacatgctttagccttaatacaaaagcagtcaaaatattattttacacatcaaacataaggaaaatccgcgttttcgatgtacctcatcgtatttcttctaatcaataagaaaaatcagtacaagcaagtagcaatatatttcaatctcaaggagaccatgtttgattgaaatcggagccacaacatcaacatccatattagtatcgtcttccttaaagaaactacaagtgaacattaggagttataaatgtgatattttttctaaaatggatacatgatagaaattgaggaaatgaatttgtgtccttatcaagtcaaatttgggtattgtttattctctatatatgaagtcacttagatcatcccaagatggtttgttttaagataaacttaaatcttataggacttacagaagcaatagactttgccactggaacgaccttgtcatcagtataattaacaaaacaattgcagacaggacaccctataattaagcatttgaaagaagcactcagattagtggggacaaggatggcatggaactaaatcacattgttacaatgctccaaaaaaacataccagatttgggcatattaccacaatttgcttctccagcagaactccaatgaataaccctaacacctttaggaaaaaaataactttatgcaaaaatgaatagtcaagacaacaattaccatttatattataccccatataccaaatgtatgatcttaaaatgggttagtaatggtcgtactgaacaaacagaattgcatggatgtgaccctaacacctttgtgtgcccgtgcgttgcaacgagagtacgctgggataaacatcgacacatatctgatcggatcttatatttccttggggtctagagaaagtttgctcggaagccaaacatgttaagacctaagtatgtgttacccttgccccaaaagcacattgttccgcgcttgtatgagaagagcagtaatcaatttttcagtagagcttccagtaaactctaatggcagttatggtgtccacgtgaatcgaactattctgacctcagtgaaaagaacagtaatcaatttgcgtaataatatgaacaacaggcctatttgcattaagaccgtattgctccacaagtgtgtcaacaaaggaatactaaagtggaaagccagacttgaccaactcaggtcaggtgtggtaaagtgtgttcgatgaaccaaaaatagcaacaatcataagactatgtttcataaatgataatacagggtaaatattccaatcctaaagccatgttatttctacaatcagaacgacacaaatccaatggtgatacctaaaataaaaaaggcttgtttggttagtgcccagccagctttttcgcttttgtcctagctttgatttacaaatgcagccggtacagaggattccatgtgttaccttgataagaacagaaaccgccgacttggatttagtgttcagaaaatgaaaaccatcaaagcaagaatttaaactcacaacacaaaagatgatgttggtttctaatattgctggtcgtaatttgtattttcctttgaccctgaagatgcatttaacatgctatttttaattatgctaatcaataatcatatctaaacgtcatagtagtctattcggatgtacccgttcctcctggacggagttgcacagggagggcaagcattgatcatcagtactttccaggtctagaatctagatcccaccccaaaatagtgaggccttaccttgcactggtggccccaacagccaccactcacacaggcaccactgcaccaaccgctgttgcgcccatatgaactgcgagctcaaaggaggctgcttgtgagagtcttcgtacgtaatgggtctaaaaatcatgtcattggtacaatgaccataatgtttgaatgaaatcacagctcgccaacaaaaaattgcttagatttcacaacagaactgctcaaaagtaggcagtacaatccctgcagtttacgaagccataagaaacaaaaattcatagctaacttgttacagattgtttattcgattgcaggattcatgtattgtaattacctccgcttcatgggccgcctagcattataaattgaaatccattgagcgttgggctccctaatctaaccttctttttaggttgttcatcttcttctagatctgcaagcaatcttccacgttcctgtacaacctatagtacataaacaaataaagataagcacagagaaatctaattatatatgaagagagggcatcctttttgaatctgaattttaattatattacagtctaaaagcatgcttgctacaatagatggtaaattctgttttactatggctttatttttttttcttccgagacaacatccatgtgattgatctttttttaatctgaatttaattatattacaatctaaaagtatgctgctacaatagatgatgtgcttgtgattgatcctttttgaaactgagtttaattatattacagcctaaaatcatgctgctatagtggatactaaacaaattctaaggaatacccacagttctaggaatatgtttctatttaccttcaatctgtaagataaagcctaaaaacatgctgcggcaatgggtcctaaatagctatcaaaaaaattgaaggcagtccatgagttgtccttatattcagttatttatgctttgcctccaacaactctagcacaccatgatttcaggttatgaagacaacaagttataaatttcagggtataaatactttgtttgtttcatcaggtagcaaacgggccaagcctgcacgtgcaagcttgggaaaacaaaggcaacaatattgcaagcaaaacatccccgattgattttacagctgagttaaaccttgtataaatgtcactggtataaggaatacaaccatgaaaacaatagaacacataagtgtgactatgtgccgaatccagagttgcttgtagggtaaccaaagattagaccaatatatgtcatcacgctcaggagccaaagtagtactcagctaaaggtatttgcatgaaaaaagtaattgattgagcagtaaaattctaacctttcatcactacacatacctgcaagcaaaaaaaatggatcaactgcaacattaagacatctcataaactaaaatgattcatagtcaagaaaagtaattgattgagcaataaaattcttcaaacatgtagctccagtggtcaataagtgtatttacatgataagaaatcaaaaatcagattcgaacacataaatcagggggcagagaacgggtgcaggggcgtacatggtaagaaatcaaaaatcatgaaaggtagtatcggtatccgtcgaagcacccatcatatcctatacactgtatacgtaggaaatacattcaaaggcatggcacgttgccagcatttcattttgaaaacagaaacatcagtgaggccgtgttctggagtaaaagttatctgggtccggtaatagccaccctgcatacttagtccgcagcaatgcgatgcagaagtcgtgagcaaagcggaagcgtccacaaaacattaattggtctgggaaactaagagccaccaccacattttcgtagcagaattcagcacataccggctagatatttgctactccaacgacataggcgttccaagcatctccttggttgaaatggtgtgattcttcatacttcacgtcccggttggcgttatattccttggcgtttccacctgactgggtatttggcatctccctcatccaaacgtggacccacttgaatccagcctcctccaagcagtccttgatctccggaatcgaccatctggccgagagcaaccaagaattacacattcgaagatggtattcctctacttgcagaaaattatcaatttgccttgtacattcagtgcatgctgtatagagataaagataaaatgacaatgaagcttcactgggacttttagaagtgtacagctgacaaaaactatagaaagccccaaagataacatctttctttattacgagctacatagatatggcattggaatgggagttggaacaaagcaaaaaacgtatcgcggaaacatctaaagcaaatgccagccaagaaaaaattcagttaaattctgcaagccaacctcatgccatggtgcaattctgcaaccaaaatactgttaaaactatacctagagtttctatgctaatgaatgagttctaatgctaatgaatttagtgaagtagctgaaagagttacacacttacagcctctgtaagattgcaccatgtgaatgggaataataagcaatgattctgaagtggagttttgacaagtaatgttcaagctacttacaggcgccaatggtatgtgaaagcatatcgcaacatctgtttctttctgccttgaaagtggagactgatccttgtttggcgactgatgatatcagactcatcttgctcccagaaatattgtatgcaaggttgtacataaaggggagaaaattaaagatttagtactgctctactctgtttaagcaactgcaaactacaatgtatcaacttgcaaagccgtctaggcccagctgcccccgcgacccagacgaccccgtccgcctcgccctgcgcctccccgttacaagagtccgcccgccagcgctgcggtcccagcgagcccaacctggcttccgcccctgggccaaggaaaccgaagccccgatggcaagcttcttcagggacagcgagcttcttcggttgcattgcattgcgctgcccaagacagaccaaccaaccagccaaccgcagccgaggatgggtgtttgcatccatgcttcgccatcctcacctcccctaaggacatgatgggcggcgtcgtctataacggcttgccccagtacatgaggatgtcctgcagcagcgggtcgccgccggcgtggccgctgacggggtcgagcatggagcccgcggggttcacgggatcggaggcgaaggtccgctcccatttgctgatcttgggctggctctgcacctcccgggccgcacgccagctgcttcggggacagcacctgctccgagcagctggagtagtccgcgtgcagccgcggcatcgagtccgacggccggtcgtagtacgccgccagctccgggaacgccgggggtagcccgcccgccgccacgaacggcttctgctccggcggggagctcaccgccaccgtggcgaacagaggcttgtggtcgccgccggcgccttctccagcccgccgcccttcttgttgtagattggggcgaatcgcgcgcgtgcgtacaggtgtctgtggcgtttgcggctggggtggggttcgcgagggcacgacgcacgggggtttctccgcggttgttcctcaggcgcggcgctggattcgcgggtggaggcgggttccgcaggaggcgcggcggctgattcacgaccgggcgcgcgcgggacccgcggggtgcaggggcgggaggtaggggatggcgggtgcaagggatcgggagcggcatggcggctgggcgcgcgcgggatcctcggaggcaggcgatggcggcgcgggacccgcggggggccgggatgggaggtatgggatggattcgcgggtgcagcggatcgagaggggtcgcacgggggaggaggcggcgggcatcacgggcgggggcacgagaggctgtggacgccctccttacgttcttaataggagtagagattgtttaagtaggcttgctcttctagaatttcgttttgttaggatgttcctggacatattttgttttgaaagggccactaattgtctccatatagtcccttacatataagactgtgttcaacggttccccctaaatttctccccctatatcccactcacgtgacacgtcagcgttctctttccccctatatctacacgctctacagcggtttcccctatatcaaacatctatactccaccacaccattttttttatactttcatcatcaactaactcaactaccatccaatatttgatttatttttatttgctctataaacagtgcgcggctgtaacttagtacacaagtaactgttctcaaacaattaagcaaatgttcaaaaaccagtatatgttcatgctagaaagccattacaaatagaaaaatataacctcacattctcagcacttctttttttgcttcagtcaatccatgatcatgacatatatacaggatataatgtaaaactttaaattctgttatcatagaccacaagatatcaacattctgcaagtgctttcttcatatgatctgaaaatatgccttgttactttctttaaaaaaaggaactgttatacagtcacactaatgaaaggtaacagaaccatgattggaattagaactggatgcgcaggtcaattcgcatggacaaccaagaaaaggtttgaaaatcttgttattactcatgtaaaaatatagctcgggaccatgccagtcttttttaaagcaattacatgcagaacatcatccattttctgtcatcccataatctacacacaaattcttcacgaaaccgttgctagcaatggttgaccatgatatgtttgcatatggaacaaactcatgccgaatgccaggcatataactccacgacagagaaaaatggtgcacgaacagtatcagattatctaataacaacttgatagccacctcctcgccgctgtgtatgttgacgcctgcagccaaaaacaacgacgcgtaggaatctgcagagacgcgtgacagaatcaatgaagaacccggcgagacgctaaccgagatagagctcgccgaaagatccgctcccgatcttcttcccaagcttaaacttccctccgaacacgtgctccattcccgcaaccctgccaacaaccgccccgtagatcgtcgccctccaatggagaacgcttacattgccagtccgcagaagattcgagccggaacgaccgggaacaagggtttccccggatctgtcaacacaaggtagattccgtgctgcgaaccgccacgtgcgacggagcagtcaaggccgaccggcggacgggcggcggcggtgaggcggatcgaattggcgagagaactcggaggttttcgtgtgggatcccgcgaagcttgaaggcggatccgcgaaagcttgaagacggatccgcgaggacgacccccactgctgttcgccgctcggagcaagacaaacgaatcgcgggacaccggcggatcgacacttaccttctccggcggcgaatacgtcgcccttggttcgcctccttcgctgtccgtggagttttccgagcgcgcggtcgcgtggccgaaggaaccggctggggagaaatccggcgcagtagcgtgtccatccatttagcgggagagagaaggaatcgggaggggagaggaggaggaggaggaagccggtgaagagaataggggcgcactgtaacccctaaaacagctacagtggtaggggagggggagccaagggcgaaccgttgaacatagtctaattcactcccactaatcgtctccatatcgccgcacctgttttctagtttaaaattattccgacattggtgtatatgaacactctagctatagtcaatatagagtaaacatccaacaagaaactggaaacaacccgaacctgcaagagtgcaaggtaatatgagcactagcctaacaaaactcaaaagtcaaagcaatattaattgacattttcagaacttgctctccataggatcagtacaataagaattaaaggatgtaaagaaattattttctccggacacattgtgatttactgatatttaacagatcaaacaaagcttgatcgatcaactagtaatcaaactcaggtctcctttgaaatggaagaaaacaaaggattcagttcctataaaaggttttcctattgaaacaaagaattagatcctaccagtcccttcaaaatttgtatgaaatgacatccttcataatatttttaaagaaaaataaacatgagatccaatctcatgttttctttcgttttgtaccttgcattcctatattcttgtttttcttgcacatgatccaaacacatgttttgtgacctccctatgttataaattgctatgggattgcaaacgcatagccaatctgatcccatgttaactcctgtttggaatctctctactaaaatttagtatagttagctaataaaaaataattattaggtttcaaacatcctcagctaatatcaaaactagttcattagctagcttaactcagctaataatttatcaactagctaacagttagctctaagggttccaaacaaaacctactttgacctataggtagacgcattacaagattattataaaaagagattacactaggtaatttttgttttgcaatggtcaagcaaaaaattagacatacgaaaaagcaagccactagtctccagaaaacatagagctactgagtactaggatatggatatatagaacaaaaaaaaaggttctgcataagcctatatagattcaccaaagtaaatagctaatagcaaaacaaataatcaaacatgtatatcaatatgattcatagaaactatattcagccagactttcaagtttgacttaattcatagaaaacatgattaatatttatgattctatgcacaactaacctaacctgatggtccggtatcaatagctctaatcaaacttcaaatgaaaatgaaaaactgcatttttttagctgtaagttttaactagtcacaaaaaatgagactgccagaaccctgaagtaaacatacagtaaaaagataaggtgcgacaaacaccagtaaacaaaaattagaaggcaaccaatttagtaacattaactgacatgacaaaaaacaacaatattcagcgaatagtttaaattcaaacaacatttattcatgattaagccatatgcggtcgcacgatagttttgggtaacgagaacacaactggtccatgaaaccagctcagtcacgactcacgacacaaaccatacaaatactttgaaagacagcaccatccatgggcaatggcagagacactagataacccagatacagcagcagcttcaacgactgatggcttaataaccaccgcgaagacggagcaccaggtggagggtgctctccttctggatattgtagtctgcaagggtgcgaccatcctccagctgcttgccggcgaagatcagacgctgctggtctgggggaatcccctccttgtcctggatcttagccttcacgttgtcgatggtgtcagagctctcaacctccagggttatggtcttgccagtcaaggtcttcacaaagatctgcataccgcccctcaggcggagcaccagatggagggtgctctccttctggatgttgtagtcagccaaggtgcgaccatcctccagctgcttgccggcgaagatcagccgctgctggtccggggggataccctccttgtcctggatcttggccttcacattatcaatggtgtcggagctctcaacctccaaggtgatggtcttgccagtcaatgtcttcacgaagatctgcattcctcccctgaggcgcagcaccaggtggagggtgctctccttctgaatgttgtaatccgcaagggtgcgtccatcctccagctgcttgccggcaaagataagacgctgctggtccggcgggatgccctccttgtcctggatcttggccttgacattgtcaatggtatctgaagactccacctcaagagtgatggtcttgccagtaagggttttcacaaagatctgcataccacccctaagacgcagcaccaagtggagggtgctctccttctggatgttgtagtcagcaagggtcctcccatcctccaactgcttgccggcaaagatgagacgttgctggtcaggtgggatgccctccttgtcctggatctttgccttgacattgtcaatggtgtctgaggactccacctcaagggtgattgtcttgccagtcaaggtcttgacaaagatctgcatgcctcccctaaggcgcagcaccaagtggagggttgactccttctggatgttgtagtcagcaagtgtgcgtccgtcctcaagctgcttgccggcgaagataagccgctgctggtcaggagggatgccctccttgtcctggatcttagccttgacattgtcaatggtgtcagaagactccacctcgagggtgatagtcttgccggtgagggtcttcacaaagatctgcatctgcaaggaaaccaaaaaaaggtaagcatataacagtagaccaaggaggaaaagaaaaggaacactataagatatatgcgtgctcaagatgtagttgccaccgtaaggtacagtagcagcatgatgccactccctacgttctattttatttgtcacggtttagttcaaaaatgaactagcgggcgacaaatattcgagaacgaaggtaatatataataaagataagcgacaagaacatgcatgttcaacaggtggatgataaagaacaaccgagcaggagccacacatctacatatttctgagcatgcatatcaaacagaacaaaacagtgcatgctcatcagataatagctaagcatgtgtatagaacaaagcaacaagacaatgcatgttcaagcaaaggtgaattgcattactataagcagtgaaattacacatattaaaccaccgtcaccggctaaatcacacaccctagagtttaacagataggcacggtgcattttaatcaggcagaagctacagcctcaacaattcaggcagaactacagcatcaacaggaactcaactctgaagcacatattcatccatcatattaattacaaacatatatgctagcacatgtagatccaaatttaattagagttctcgctgcagcttttctaggcggcaggtgtggccgcgtaaacaaggaactaaaatccactctagctaacgcgtggatcaggcgttgccagaaaggcagaagcaatcaggctaaaaaaataagaccagcaaactagtacgtatacaccatattaattatgaatacatatgttcaacccatgcagatccaaatctaatgagaccagcagctaccgtataataaatcattcgattctactccgatctggatggaccttacaacgaggccaaaagcaacgaaactgatctgacgaaccagacgaacaggcctaagaaacgagcctgttggaatcatcacagcgaacaagatcaaggttagatgcatcaagatcaaggttccatctaataggacgcaccattctgcatcaggtacttatttaattaaaaaggaaaccacgagaagatccaaccctaagaaacgaggctgttggaatcgtcacagcgacccaacccaacccaacccatctcagagcctcttacaagcatatcccacaattactagatcgaggactcggagctacgataatagatcgccagatctgggaatcgaagcccccatataacccgtaataaatcgtatgttcgtatacctagcaagcagaggaggtgaagggagagtggaagcgggaggatggatgatcgcagttaccttgaagcgaggggaggggagtgggggatcggcgaggctcgcaaggacgacgattcggatcggggctgtgtccgcgtacgcccaagaacacagacgaagatgagatgtggggaaaggcgaggagaggatggttatttatggtgcgacgataacgctaggggaggggaatgccgtgtgcagtgacgctttcgtggcggtctaacctctaaaattaatatctagttgttccaaacaccgcgttcctattagatcggttttaaaggtaggtttggtttggttttagttttggcttttgtttcctaaaagataaaaattaaactaaaggactggatttaagcagttttttttaaaagctgactttttcgtagtgtaaaattgaaagcttatttgacctgtttttagtggattttttataaaactgtgaaaatatatatcaaagaatttttaatggtttttagtggtttacactaaataatttttagctttttaatagctcatagtctgcaatagtttttttcatagtttaccgccacagtccaactaaatagaacgtaaaatagtaccttagtgtctgctccgccacgcaagacgcaatttccggatgctgccagcccgctgcggcgcaactgcgcaaggacccacgcagagccttcgagaaggccagggccagcgagagagatgccgttcaagttcattgctttgcgtcaacgtctccaccgtctgcttcgcttcgttgcaacgcttaggttatagccctacgatctttggcaatggatcctatgcccgatttcccgctttctcagatgggtaaacgggacagggatgtagaagtatttttcatccctgtttctgtgggaatccgtcaaacctgtacgtggtgatgttttcgtatactagctaataataaaaacaaataattatttgggtaagagatcaatcattgtacaaatatgtttattttaatatacccataatgatttcttacatctaacaatatatataagtgaaagtgtttttattaataacaaaggatgcatttcctaattataatgtaaatagggacgttgatctccgtcggaaatttatgcccgtggggaatatggatggggaagaaatgtcttctgtaaacgttcgtgggtattcccgcgaggaaatttctgcgtcgtgggatgggtatgaagagctattcctcgatgagaaattttccattgccatccctaatcccgagtaggaataggggtggacagtgatcacaatataaaaggagcgattgatgatagagacaacatcataagtgagggagacaggtcagggacacggggcaggaggaggcgtcgagggagaggggagagagaatacatgatctaaataatattatctatcagatttgaatggatatgggagaacatgttatccatcgatttgaaccgctagttttgatactgtgttagatttaacgaatgttatgggtgtagatgtgatttgtttagatagattttgtaaagtttaaactgataaattatataatgatatagattagaatgtagattggtcgacaccacgtggttggcacatttctcctacctcactgatgtatgtgacctaccgcctggaagttttccccctaaggctggctccagcagggtcctgtaaaagctcctgtactctacatatagaggtttgtcagatcctctatccctccaacaagggactctaaaaggtactctaaaatttagaggatgacatgcatgcgctatgtatagaggatgtacggcggtgctctatatagtgtgctgatttctgtgcacgtgctgacgagcggtaaaaaaataatatagaatgtcaaatctagtagcactgttgatatagaggatgaaatttaggggatattgctggagatgaagaagatatagagtacaaaatcttttagagagtgctgtaaaggacagagaatattcttttaggggatgaaatttaggggacgttgctggagatagcctaagctaaaatgacaccggtgccttacagtctatttagttcgatgcatcacaatgcacaattcaccatgtctaaagtttaggcagtttaattgatttaaatgtgtgtttagtttgtagtcacaatcatgacaagtttttgctactttggtaaccccattttttcaaatgatttttcatttattagtcaatcactaactagtctgtacgatgaccttcttcagagcattattaataaggcaagactgtggaatcttcttaagctccctttaccggatattggtgaccatgatttctcgattgttcagtatgcagatgacactcttttgattatggaggcctgtcctaagcaacttttcttcctcaaggcaattctcaactcttttgcttcttctactggccttaaggttaattataacaaataaaatatgtactctataaacgtgccttctgaaaagatggagatcctctctcgaactctcaattgccagattggagaaataccattcacctatcttggtttgcctctaggccttgcgaaacccagaaaggaacactttctgcctcttattcaaaggactgagaagagattatcttgctcttcaaattttttatctcaagctggacgcttggagttggtaaattcagtcttctcagccttgccaaccttctttatgtgcatgctcaagatacctaaaaccatcattaagcaaatagacatgttcaggaaacattgtctgtggagagggaatgacattagttccaagaagccgcctctgattgcttgaaattcggttactcagagaaaagtgaatggcgggctgggggtgtttcgccttgaaacccagaatgaggctctcatgatcaattttttgcataaattcttcaataacaacgacttaccctgggtgcatctcgtttgggataaatactatttgtctcgtggactcacaggccatagaaacattggttttttctggtggaagagcatgatcaagctccttcccaactttaagggactggcactcccagtcattggcaacagcagatcaatttcgttctgggaggatcagtggagtcagaacatcccaaggcaaaaattcccagaattattctcttttgtcaaaaacacaaaattgactattgaagaagctaaagagtaggatcagttcgctggtttttttcatttgcctatctctgaacaagcatatgatcaatacctggagttgcaggtggtttgggagcaaattgtcctcagtaatgctcacgaccgttggcgatacatttggggctttgacaactactcttctcaaaaagcttacagacattttatgggccagacgcaggttcaccctatctacaggcacttatggaaaagcaaatgtcagcctaagcatagagttttctattggttgtggcttaaaaatagactaaataccagagatatgctgagaaggaaaaacatggaactggaatcttattcttgcgagaactgtttatggcaaagagaggagaccctatatcatctgttcctcagatgcaattttgcgaaagcttgctggaactcaattggcataaccctccagaattactaatcctgaggagacatcagcgaaccttaaacaccagcttaacgtccccttctctatggagattattattctcatgacatagagcatcttaaaaagccgaaatgagtggctgttttcaaacaaagatccttcgattcatcactgtacacaagaattatgtaaggagttgcggttgatcatgcacagagcgcgtgggaactttgacatctccatcccgaattggctgagtctgtggcagacataggagtagttctttctaatccattgcatttaaacttattatttagatctctcggattaacttttgtaaaaaggttaagttgtaacattttcttttctcatcttcaataaaattctcagtaggcccccctcctgattcttcaaaaaaaaaagtctgtacgatttattatggtttatattgagtcaatcgatcacagcttggtgcaatttctaaccgcattttcttgatgccatcgccaaagaaatcacaagggcccctcacttgctgttcttgtgagtaaacaagtacaaacaagatgattgtgcctcgttaggcatgatgcgttttggataaggccagtggacaatgtgtcaccgtctcgcttagctggatgcagtacaatatggatacagattcgtttcagggacatcttccttcaatccttccatcgatgtgaacatattctgaaacccatggcattctttatctgaagctgaccggttcatttttcttctacgatgactagtctgggagctaaaatactggaaagggattggagatgataaaattttattcttatttaaaattgaataagaaagtgattttagctcatccaatcatctccggttttgtgactcaccaaactagccctgagtgatctagaacccgcccaatcattgcacctcgacattttcctttttgaaaaacatgaaatataatgacgtgttagatcgttatatgatcttcatgatggattattgaaaaaggcttgtttttttagttttttaagggagttgtttcacttgtttggcagattttaggaaacaatatcctatagtgctagtttgggagccaaaaaacggagagaattagatggattaaaatttccttattactcaaatttaaataaagatgagattttagcttatttagtactctccggtttttggactcctaaacactatcccctaatgttggaaggggccactgacgcatggctcaggcctcagcgtatgataggacctgtcggggaccataattaggggtacccccaagactcttaaactcggctggtaaccaccatcagcacaagccgcaaaggcttgatgggcgcaatacaggtcaaagcttcgtccactcaagggacacgatcttgcctcgcccgagccgagcctcgggcaggaacagtagacccaggcggattcacgcctcgcccaagggcctcctcaagcaacggacgcaccttcaactcgcccaaggcccagctcgggcaggcttcgcagtgaagcaaccttggccagatcgcctcgccaaccgaccgtatcgcaggagcattcaatgcaaggatcgcctgacaccttatcctgacgcgcgttcctcagtcggcagggccgaagtgaccgcagtcacttcgcccctccactgactgacctgacaggaaaacagcgccgcctgccctgctccgactgctgtgccacccgccagggtgaggctgacagcagccgagtccagcctcaagcaccataggaaactccgcctcgcccgaccccggggctcggcccccgccttgacctcggaagacggtctccgcctcgcccgaccctggggctcgccccccgcctcgacctcggaagacggtctccgcctcgcccgaccccagggctcggactcaacctcgacctcggaagacggtctccgcctcgcccgaccccggggctcggcccccgcctcgacctcggaagacggtctccgcctcgcccgaccccagggctcggactcaacctcgacctcggaagacggtctccgcctcgcccgatcccagggcccggactcagcctcgacctcggaagacggtctccgcctcgcccgacccagggctcggactcagcctcgacctcggaggaatcaccgcctcgcccgaccttgggctcggaccgaccacgttacaggggggtacatcattaccctacccctagctagctcaggctatggggaacaaaaccggcgtcccatctggctcgccccggtaaacaagtaatgatgacaccccgcgtgctcccatgacgacggcggttctcagccccctacggaagcaaggagacgtcagcaaggacccgacagccccgacagctgtgcttctatagggctcgagcgctcctccgacggccacgacatcacatcaacagggcaccaacacctctccgacagccacgtcggcatgtacatagggccctggctcctctctgctagacacgttagcacattgctacacccccattgtacacctgggccttctccttacatctataaaaggaaggtccagggccctcgtacaaaggagggtggccgcgcgggaggacgggctgacggacaggctctctctctctctctctctctctctctctctccctcgcggacgcttgtaaccccctactgcaagcgcatccgccctgggcgcaggacaacacgagtcgcggttcccttttttctccccttgtgttctgtctcgcgccgacccatctgggctgggacacgcagcgacaatttactcgtcggtccagggacccccccggggtcgaaacgccgacagttggcgcgccaggtaggggcctgctgcgtgttgccgaacaactcccgtcaagctccagatgggtagtctccaacaacctctcgaccctgggacgctgctccatttcgggagtctcgagttcatgtccctcgacggcagctacgacatggtactccttcctccgccgcgtgacaacggcaatggcggccgtcagcccgcccgccggcggtggaatcgacgacgtcttccccccatggcggaagagcagcatccaggcctgtcccgtcaccttccccgccgcttgaggaggaggcggggcaaccatggccaagcaggaggcggcacctcgttggctgtcgagcgagtcgacggcgccggcaccccagcgggggacacgtcgggcgttgacctcgcgtctgagacgaagacgagcgtcgtttccccgcaacacgccaaccccaagtggatggatgacgccagcacgctcgcaaaggacttgctgggcgttagcctcatacctgagataacggtgcagtccgtccccgacgcgacttcgtcaccatccgtcgatcaagaggtaccgtccgtttttccaccctgtgccctttagattcagcttcgacccaccaagcaaccccgcttcggtggacgctttcataaaggcatatcctaaccttccggggtaccatatgtggtcaacctgggaccgactgacgcccgtctcgacctatgggcccccgggttccgaggaagatgacgaacccgactctggttgggatttctccgggcccggtaaccccagtgccatgcgagacttcatggccgcatgtgactactgcctatccgattactccgatggtggccacagccttgacgacgaggactgtggcccaagtcgcgaatgtttccacgtcgatctagggggtctcgacgaaggcaaccaccttggtatgtcggaggacggcgatccccctaggcccgcgcctcgcgttgacatccttcgggagctagctgtggtcccagtccctgtgggggggggggtcaggacacacagctcgagcaaatccgcgagatgcaggccaggctcgacgaggaaggaggacaacttgtgcagctccggtagaacatcgggcaggagtgggcaggccgagcaccagccggagaagcgcgtcatctggcccaggacgtccagcaccgcatcgctgacgatgccagggcaaggctgcccccggctttcagtggggtcggccagaacctggctgcagcagcaatactactccgagcgatgccggagccatccaccaccgaggggcggcgtatccagggagaactcaagaatctcttggaggatgccgcagtccgacggactgaaagctctgcctctcgaaggcaggggtacccccggagcatcgcgccgtgacttcccgattcatgcgagaagcctcggtccacaccgggcgcacgcgggacgcaacgcctgcagccccgggtcgcctcggcaacgagcaccaccaccgcgatcgtcgagcccacctcgacgagaaggtgcgccgagactaccaccccaggcgtgggggacgctacgacagcggggaggatcagagtccctcgcccgaaccatccggtccgcaagctttcagccgggccatacgacgggcaccgttcccgacccggttccgagccccgactatcatcaccaagtactcgggggaaacaaagccagaactgtggctcgcggactaccggctgacctgccagctgggtggaacggacgatgacaacctcatcatccgcaacctccccctgttcctctccgacgccgcccgagcctggctggagcatctgcctcctgtgcagatctccaactaggacgacctggtcaaagccttggccggcaacttccagggcacatacgtgcgccctgggaactcctgggatctccgaagctgccgccagcagccgggagaatccctgcgggactacatccggcaatttttgaagcagcgcaccgagctgcccaaaatcaccgactcagatgtcatcggcgcgttcctcgccggcaccacttgccgcgacctggtgagcaagctgggtcgcaagactcccaccagggcgagcgagctgatggacatcgccaccaagttcgcctctggtcaggaggcggtcgaggccatcttctggaaggacaagcagcctcaggggcgccagcaggaagacgtccccgaggcgtccgctcagcgcgacacgaagaagaagtcgcaagcgaaacgcgacgccgccgacgcagaccttgtcgccgccgccgagcacaggaacccttggaagcctcccggaggggccaacctgttcgacaagatgctcaaggagtcgtgcccctatcatcagggtcccgtcaagcacacccttgaggagtgcgtcatgcttcagcgctacttccataaggccgggcccccggcggaaggtggcaaaggccatgacaacgacaagaaggagggccacaaagcagaggagttccccgaggtccacgactgcttcatgatctacggtgggcaagtggcgaacgcctcagctcagcaccgcaagcaggagcgccgagaggtctgctcagtgaaggtggcggcgccagtctacctagattggtccgacaagcccatcaccttcgaccaaggcgaccaccccgaccacgtgccgagcccagggaagtacccgctcgttgtcgatcccgtcatcggcaacgtcaggcttaccaaggtcctcatggacggaggcagcagcctcagcatcatctatgccgagaccctcgggctcttgcggatcgatctgtccacgatccgggccggtgtggcgccctttcatgggatcatccccggaaaacgcgtccaaccttttgggcaactcgatctgcccgtctgcctcgagactccctccaacttccgaaaggaaaccctcacgttcgaggtggtcgggttccgaggaacctacaacgcagtgctggggagaccatgctacgccaagttcatggccgtccccaactacacctacctcaagctcaagatgtcgggccccaacggggtcatcaccgtcggatccacgtaccgacacgcgtacgaatgcgacgtggagtgcatggagtacgctgaggccctcgccgaatccgaggccctcatcgccgacctggagagcctctccaaggaggtgccagatgcgaagcgccacgccggcaacttcgagcccgcagaggcggttaagtccgtccctctcgaccccaacaacgacgctccaagtaggtccggatcggctctgagctcgaccccaaataggaagcagtgctcgtcgactttctccgcgcaaacgccgaggtttttgcgtggagtcctcggacatgcctggcataccgagggatgtcgccgagcactcgctggatatctgagctggagcccgacccgtgaagcagcctctgcgccgattcgacgaagaaaagcgcacaaccataggcgaggagatccacaagctgatggctgcagggttcatcaaagaggtattccatcccgaatggctagccaaccctgtgcttgtgaaaaagaaaggtgggaaatggaggatgtgtgtagactacaccggtctaaacaaagtatgtccgaaggttccctaccctctgcctcgcatcgatcaaatcgtggattccactgctgggtgcgaaaccctgtcattccttgatgcctactcagggtatcaccaaatcaggatgaaagagtccgaccagctcgcgacctctttcatcacaccttttggcatgtactgctatattactatgccattcggtttaaggaatgcaggcgcgacataccaaaggtgcatgaaccacgtgttcggagagcacattggccgaacgatcgaggcttacgtcgatgacatcatagtcaagacgaggaaagcctccgatctcctcactgaccttgaaacgacattcaagtgtctcaaggcgaaaggcgtaaaactcaatcctgagaagtgtgtcttcggagtcccccaaggcatgctcctggggttcatcgtctccgagcggggcatcgaggccaacccggagaaaatcgcggccatcaccaacatggggcctatcaaggacttgaaaggagtacagagggtcatgggatgccttgcggctctgagccgcttcatctcgcgcctcggcgaaagaggcctacccctgtaccgcctcttaaggaagaccgagcgcttcacttagacccccaaggccgaggaagccctcgggaacttaaaggcgctccttacaagcgcgcccatcctggtgcccccccgctgcgggagaagccctcttgatctacgtagccgcaaccactcaggtggtcagcgccgcgatcgtagtcgagagacgagaagaagggcatgcattgctcgtccagaggccggtctacttcatcagtgaagtactgtccgagaccaaaatccgctacccgcaaattcagaagctactgtacgcggtaattctgacgcggcgaaagttgcgacactacttcaagtctcatcctgtgaatatggtgtcatcgttccccctgggggagatcatccagtgtcgagaggcctcgggtaggattgcaaagtgggcggtggagatcatgggcgagacaatctcgttcgctcctcggaaggccatcaagtcccaagtcttgtcggactttatggctgaatgggtcgacatccagcttccagcagctccgatccaaccggaactctggaccatgtttttcgacgggtcgttgatgaaaacaggagcaggtgcgggcctgctcttcatctcacccctcgggaagcacctccgctacgtgctgcgcctccatttcccggcatcaaacaacgtggccgagtacgaggctctggttaatgggttgcgcatcaccatcgagctaggggttcggcgcctcaacgctcgtggcgactcgcagctcgtcaacgaccaagtcatgaagaactcccattgccgcgacccgaagatggaagcctactacgatgaggttcggcgcctggaagacaagttctacgggctcaagctcaaccacgtcgctcgacgatacagcaagactgcggacgagctggctaagatagcctcgggacggacaacggttcccacggacatcttctcccgagacctacatcaaccctccgtcaaaaccgacgacacgcccgagcccgaggaggcctcggcccagcccgaggcaccctcggcccctgagggtgaggcactgcgcgccgaggaagagcggaatggggtcacgcctaatcgaaactagcagaccccgtgcctgcaatatctccaccaaggagagctacccctcgacagagccgaggctcggcgactggcgcggcgtgccaagtcgttcgtcttactgggtgacgagaaggagctctaccaccgcagcccctcaggcatcctttagcgatgcatatccatcaccgaaggtcaggagctattgcaagaaatacactcgggggcttgcgatcatcacgcagcacctcgagccctcgttggaaacgccttccgacaaggtttctactggccgaccgcggtggccgacgccactaggattgtacgcacctgccaagggtgtcaattctacgcaaggcagacacacctgcccgctcaggccctgcaaacaatacccatcacctggccgttttgaaagggaattaggcttacacctagtccctaattaattttggtggttgaattgtccaacacaaacaatcggactaactagtttgcccaagtgtatagattatacaggtgtaaaaggttcgcactcagccaataaaaagaccaagtattggattcaacaaaggagcaaagaggcaacgaaaggccctctggtctgggagcaccggactgtccggtgtacaccggacagtgtctggtgcaccaccggacagtgtccggtgcaccagaggactccaacctgaactcgccaccttcgggaaattccagaggcactcgcgctataattcaccggactgtccggtgtacaccggacagtgtccggtgcgccaaggaggagcggcctcaggaactcgccagcttcgggaaatgccaacggctagtccgctaaaattcaccggacatgtccggtgtgcaccggactgtccggtgcaactccggagcaacggctagtcggcgccaacggctacctgcggcgcattaaatgcgcgcgcagcgcgcgcagaagtcaggcgcgcccattctggcacaccggacaaggaacagtgcatgtccgatgtgcaccggacacccagacgggcccacaagtcagaagctccaacggtcagaatccaacgacagtgatgacgtgacgggggcaccggactgtccggtgtgcaccggactgtccggtgcgccatcgtgcagacaacctcccaacggccacatttggtggttggggctataaataccccaaccaccccaccattcattgcatccaagttttccacttcccaactactacaagagctctagcattcaattctagacacaccaaagagatcgaatcctctccaaattccacacaacgccatagtgactagagagagtgatttgcttgtgttctttcgagctcttgcgcttggattgctttcttctttcttgattctttcattgcgatcaaggtcacttgtaactgaggcaagagacaccaaacttgtggtggtccttgtgggaactttgtgttccaagtgattgagaagagaaagctcactcggtccgtgggatcgtttgagagagggaagggttgaaagagacccggcctttgtggcctcctcaacggggagtaggtttgcgagaaccgaacctcggtaaaacaaatccgcgtgtcacactctttattttgcttgcgatttgttttgcgccctctctcgcggactcgtttatatttctaacgctaacccggcttgtagttgtgtttatatttgtaaatttcagtttcgccctattcaccccccctctaggcgactatcaattggtatcggagcccggtgcttcattagagcctaaccgctcgaagtgatgtcgggagatcacgccaagaaggagatggagaccggcgaaaagcccactacaagccacgggagcacttcatcggaagagtcccgcaccaagaggagggagaagaagaagagctcctccaacaaagggaaggagaagaaatcttcttctcaccacaaagagaagaaagaaaaatcttcttctcacaagccgcatcgaagcggagacaagcaaaagaggatgaggaaagtggtctactacgagaccgacacttcatcaacatcgacctccgattccgatgcgccctccgtaacttctaaacgccaagagcgtaagaagtttagtaagatccccctacactatcctcgcatttctaaacatacacctttactttccgtcccattaggcaaaccaccaacttttgatggtgaagattatgctaggtggagtgatttaatgcgattccatctaacctcactccacaaaagtatatgggatgttgttgagtttggtgcacaggtaccatccgtaggggataaggattatgatgaggatgaggtggcccaaatcgagcacttcaactcacaagcaacaacgatactcctcgcctctttaagtagagaggagtataacaaagttcaagggttgaagagcgccaaggaggtttgggatgtgctcaaaaccgcgcacgagggagatgagcttacaaagatcaccaagcgggaaacgatcgagggggagcttggtcggttcctgcttcgcaaaggggaggagccacaacacatgtacaaccggctcaagaccttggtgaaccaagtgcgcaacctcggaagcgtaaagtgggatgaccatgaggtggttaaggttattctaagatctcttatttttcttaaccctactcaagttcaattaattcgtggtaatcctagatatactaaaatgacccccgaggaagtaatcgggcattttgtaagttttgagtgcatgatcgaaggctcgaggaagatcaacgagcttgatgatccatctacatccgaagctcaacccgtcgcattcaaggcgacggaagaaaggaaggaggagtctacaccaagtagacaaccaatcgacgcctccaagcttgacaatgaggagatggcgctcgtcatcaagagcttccgccaaatcctcaaacaaaggagggggaaagactacaagtcccgctccaagaaggtttgctacaaatgtggtaagcccggtcattttattgctaaatgtcctatatcaagtgacagtgaccgaggcgacgacaagaaggggagaagaaaggagaagaagaggtactacaagaagaagggcggcgatgcccatgtttgtcgagagtgggactccgacgaaagctctagcgactcctccgacgacgaggacgccgccaacatcgccgtcaccaagggacttctcttccccaacgtcggccacaagtgcctcatggcaaaggacggcaaaaggaagaaggtaaaatcaagatcctccactaaatatgaaacctctagtgatgaaaatgctagtgatgaggaggataacttgcgtaccctttttgccaacctcaacatgcaacaaaaggaaaaacttaatgaattgattagtgccatccatgaaaaggatgatctcttggacacccaagaggacttccttattaaagaaaataagaagcatgttaaggtaaaaaatgcttacgctctagaagtagaaaaatgtcaaaaactatctagtgagctaagcacttgccatgagatgattgacaaccttagacatgaaaatgctagtttaaatgctaaggttgattctcatgtttgcaatgtttcaattcccaatcctagagataataatgatgatttgcttgctaggattgaagaattgaacacttctcttgctagccttagagtagaaaatgaaaaattaattgctaaggctaaagaactagatgtttgcaatgttacaatttccgatcttagagataataatgatatcttgcgtgctaagatcgttgaacttaattcatgcaaactttctacatctactattgagcatgtcactatttgtactagatgtagagatgtcaacattgatgctatacatgatcacatggctttaattaaacaacaaaatgatcatatagctaaattagatgctaaaattgccgagcataacttagagaatgaaaaatttaaatttgctagaagtatgctctataatgggagacgccctggcatcaaggatggcattggtttccaaagggaagacaatgtcaaacttagtgcccctcctaaaagattatctaattttgttaagggcaaggctcccatgcctcaggacaacgagggttacattttgtaccctgccggctatcctgagagcaaaattaggagaattcattctaggaagtctcactctggccctaatcatgcatttttgtataagggtgagacatctagctctaggcaaccaacccgtgctaagttgcctaaaaggaaaactcctagtgcatcaaatgagcatgacatttcatttaagacttttgatgcatcctatgttttaactaacaaatccggcaaagtagttgccaaatatgttgggggcaagcacaaggggtcaaagacttgtgtttgggtacccaaagttcttgtgtctaatgccaaaggacccaaaaccatttgggtacctaaagtcaagaactaaacttgttttgtaggtttatgcatccgggggctcaagttggatactcgacagcgggtgcacaaaccacatgacaggggagaagaagatgttctcctcatatgagaaaaaccaagatccccaacgagctatcacattcggggatggaaatcaaggtttggtcaaaggtcttggtaaaatagctatatctcctgaccattctatttccaatgtttttcttgtagattcattagattacaatttgctttctgtatctcaattatgcagaatgggctacaactgtcttttcacagatataggtgtcactgtctttagaagaagtgatgattcaatagcatttaagggtgtgttagagggtcagctatacttagtagattttgatagaactgaactcgacacatgcttaattgctaagactaacatgggttggctctggcaccgccgactagcccatgttgggatgaagaatcttcataagcttctaaagggtgaacacattttaggactaacaaatgttcattttgagaaagacaggatttgtagcgcatgccaagcagggaagcaagttggcactcatcatccgcataagaacataatgacgaccgacaggccactagagctcctacacatggatctattcggcccgatcgcttacataagcatcggcgggagtaagtactgtctagttattgtggataattattctcgcttcacttgggtgttctttttgcaggaaaaatctcaaacccaagagaccttaaagggattcttgagacgggctcaaaatgagttcgccttaaggatcaagaaaattagaagcgacaacgggacggagttcaagaattctcaaatcgaaggcttccttgaggaagagggcatcaagcatgagttctcttctccctacacgcctcaacaaaatggtgtagtggagaggaagaatagaactctattggacatggcaagaaccatgcttgatgagtacaagacatcggatcggttttggaccgaggcggtcaacaccgcctgctacgccatcaaccggttatatctacaccgaatcctcaagaagacatcatatgaactcctaaccggtaaaaagcccaacatttcatattttagagtctttggtagcaaatgctttattcttgttaaaagaggtagacaatctaaatttgctcctaagactgtagaaggctttttacttggttatgactcaaacacaagggcatatagggtctttaacaaatccactggactagttgaagtctcatgtgacgttgtgtttgatgaaactaacggctctcaagtagagcaagttgatcttgatgagataggtgatgaaagaggctccgtgcatagcattaaggaacatgtccattggggatgtgtgtcctaaggagtccgaagagcctccaagaacacaagatcaaccatcctcctccacgcaagcatctccaccaactcaaaatgaggatgaagctcaagttgatgaaatagaagatcaagcaaatgagccacctcaagatgatggcaatgatcaagagggagatgcaaatgatgaagacaaggaggaagaggaacaaaggccgcctcacccaagagtccaccaagcaatacaacgagatcaccccgtcgacaccatcctcggcgacattcataagggggtaactactcgatctcgtgttgcacatttttgtgaacattactcgtttgtttcctctattaagccacacagggtagaggaagcactccaagattcggattgggtggtggcgatgcaagaggagctcaacaacttcactaggaatgaggtatggcatttagttccacgtcctaatcaaaatgttgtaggaaccaaatgggtcttccgcaacaagcaagacgagcatggtgtggtgacaaggaacaaagctcgacttgtggccaagggatactcccaagtcgaaggtttggatttcggtgaaacctatgcacccgtagctaggcttgagtcaattcacatattattagcctatgctacttaccatggctttaagctttatcaaatggacgtgaaaagtgccttcctcaatggaccaatcaaggaagaggtctatgttgagcaacctcccggctttgaagacagtgagtatcctaaccatgtctataagctctctaaggcgctttatgggctcaagcaagccccaagagcatggtatgaatgccttagagatttccttattgctaatggcttcaaagtcggtaaagccgatcctacactctttactaaaactcttgaaaatgacttatttgtatgccaaatttatgttgatgatattatatttgggtctactaacgagtctacatgtgaagagtttagtaggatcatgacacagaaattcgagatgtctatgatgggggagttgaagtattttctaggatttcaagtgaagcaactccaagagggcaccttcattagccaaacaaagtacactcaagacattctaaccaagtttgggatgaaggatgccaagcccatcaagacacccatgggaactaatgggcatctcgacctcgacacgggaggtaagtctgtggatcaaaaggtataccggtcgatgataggttccttactttatctttgtgcatctcgaccagatattatgctttccgtatgcatgtgtgcaagattccaagccgaccctaaggaagctcaccttacggtcgtaaaacgaatcttgagatatttggcttatactcctaagtttgggctttggtatcctaagggatccacttttgatttaattggttattccgatgccgattgggcggggtgtaaaatcaataggaagagcacatcggggacttgccagttcttgggaagatccttggtgtcttgggcttcaaagaagcaaaattcagtcgctctttccaccgccgaagccgagtacattgccgcaggccattgttgcgcgcaattactttggatgagacaaaccctgcgggactacggttacaaactaaccaaagtccctttgctatgtgataatgagagtgcaatcaagatggcggataatcccgtcgagcatagccgcactaagcacatagccattcggtatcactttttaagggatcaccaacaaaagggggatatcgagatttcttatattaacactaaagatc

SEQ ID NO: 25 - DNA, 3439 bp, Zea mays
  gene (1)..(3439)
gatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctataatttctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcacatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatcttcgtgaagactctgactggcaagactatcacccttgaggtcgagtcttctgataccattgacaatgtcaaggccaagatccaggacaaggagggcatccctccggaccagcagcggctcatttttgccggcaagcagctcgaggacgggcgcacgcttgccgactacaacattcagaaggagagcaccctccacttggtgctgcgtctcaggggtggcatgcagatcttcgtgaagacacttactggcaagacgatcacccttgaggtggagtcctcggacaccatcgacaatgtcaaggccaagatccaggacaaggagggcattccaccggaccagcagcggctcatctttgctggcaagcagctggaggatggccgtacccttgcagattacaacatccagaaggagagcaccctccacttggtgctgcgtctcaggggtggcatgcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcag

SEQ ID NO: 26 - DNA, 3415 bp, Zea mays
  gene (1)..(3415)
tacgtacgtacgtgcatggtcgacgacgatccatccatcgtccaggcaccaccagatcgagaagtggcgtggtggaaagtggagtgacgagctagctcacgcacgatggcgacgaccgcgtcccgggcggcgagcgcgaggacgtcggcgcaggagacgacgccggggcaggcatcctcgacgagcgccttgacgcggtcgacgaggtcgaagccgcgcagcgtcaggttcggcggcgcgtccttctcggccacgctgccggcggtggagttgagcaggacggaggcgtcgcagccctgctgggacgagcgagcgcgtggtgggacacatcacacacatgcacacacccgcggtcaggctggcaccacgccacgcaatggacgacgcacacgctgacacgcacacgcacgcacgcacgtaccctgacgaagcagtcgtggaagtgcagccggagcaacgcggcggcgacggtgggcacgcggcggacgtgctgccggacgaagtcgcccaccacgcgctccacgcccgggcagctctcggcgtagaaccccatcctgagctgcccggccgcgccggcgctggcggccaggacgacgagcaccatggccactccaagaaccaccggcgccgccggcactacggccatcctcctgctgctgtgcctctgtgtacactagcagccgtgtgtgtgtgtggcgaagaagagacgagtacgagtgtacacaggtctgtggactgggacgagacgatggtctataaatacatggaatgttttctttgttttgcgttgggcctacatacacacacacacacacactccagatcgagcttgcttaactaacacactgacatttgcagagctaatagcctaatactgatcgaattgttcagataaaaaaaaggggattcgatagggtttcttgcagcagcagctagcagcagtagagatcgaatcgagctatgatggtagaggccgcaagctgcatcccggttaagtttcgcagcgctttcacccgcccactcctagctagtcctagccaggcagcacgtgtgcgtgtgtgcccaccaggaatgcgattcgtgcggtctcttttgcagtcctcaccgtccatggttgcggttgttgaggttgaggcatcggcgtcggcgtctgcagtgggtggaagaaagagcaagaaaagaacatgatcctttcctttcctttcctgccatggcctcaaagccccccctagctcgctagctggctggccccggcctcttctgcgcaactttcagcggctcatcatcgcctctttcaggtcatcatcttcttaattaattaattcgctgcactgttctcgtttccatgcggcgtatacgtcaccgacgcacaatcgtcactcttctgtgcgtgggccggtcttgtgatgagactggtcgatcaacgggctctgtcgtggagaaagagtgagccgatcaaaaagcgaagatctccttcaggcatcctctcggttcttgggccacgcgctgtatgcagcagctcctcttttaccgagaggggatggaagctgtgactgtgaggtaggcaaagcatgcgcaattgcgcatcacctgcggctgcgtgcactcggctgatgagcaggcagcagctggtcaccaccttgcagccaatttttctcgagaaaacatgaagccatagcctgccctccaattcagccaccagaaagaaatacaatcctacgcgatattttggatttagcaagaaccagcgatcagaacccagtagcgctgcaacgaagtgtaagccggactaaaggaccgagcttttcagatcctgtagctagctaatagcattcagtgaactgaagttttagctagtaagaaacgggaggtctgatggaatcatttttttgaagtaaaaattactgtaggggggcctacagtgtctgatggaatcatggaataccagctagacaagttcttgcgtctaccgaggaacctggggcgtctctgcccaggaacgacacttggatgtctaatgaaacacaaacaccagctgaacaaatctgtcctcacgaatctggatgtctgatgaacaccagctgaagaaatctatcctcacgcaacatcaagagaaataaccggaaacagccctatttagcagacttttaactgacagcttattcataatttaatggtgtatttggtggcaatgacggatgagacgatctcgtagagttcaggatcagaggttataatataaccatctcagtgccgtctatagctatccatcagaattagacggaaacgtcgtggtcccagctatcccgcaaccaaacacacaagacatcacaacggttacggatagaacacgagtacaaccggtccattaaaccgaagtcaccaagagttaagagaaccctgtatacttcagttgatgtgatcaagttgctgtcttgcattgtatgccctgcttccagggaccatagagctttcaaaggaattattatgattatggtcacaggaacactagagcatcgagaaaatttaaccttgaagaaaaaacctaactactccttagctagaaggcatcctttcatagtaataacctggatcgcttaaatagataatatggctgtgcacatgatcttttggattcatcaagaactacccagaacccaataacaaagcagcaaaaccaaaagtcaaacatgttatgctgtaagccagagtaaaaaactgagcttgacaaaaccaagttaacattcaacaaaccaaacacgttaagctgtaagccatagtgggaaactgagcctgacagaatcaagttaacattcagcaagaaacggtagaaagcaagaacctggaggggtccaataaacaccagcgaatcaaatttgatcccaggcagttaattaggagatataaccagaaaaaaacataatgagcagacttttaagttcaaatatcaaacttcataaggattcaagccatactgctgcagaagagttttgggtacaacacagaggacacaacaggtccattaaaccaacgaagccacaaccacgattcatgacacacaaaccacagatgtttattagacgacgacatccatatagaggtacaccagagggcaccagacgacgcagatacccaggtacagcagcagcttaaatgaaccatggcttactgaccaccgcggaggcggagcaccaggtggagagtgctctccttctggatgttgtagtctgctagggtgcggccatcctccagctgcttgccggcgaagatcagacgctgctggtctggggggatgccctctttgtcctggatcttcgccttcacgttgtcgatggtgtcggagctctcaacctccagggttatggtcttgccagtcaaggtcttcacaaagatctgcataccacctcgcaagcgg

SEQ ID NO: 27 - DNA, 11582 bp, Zea mays
  gene (1)..(11582)
aagagaatctattgtgttagttaatgctggtgaatcaaacctggagagcattttatttatattaataaattgtacacatgcttatcttattagcaatcctgtttaccatctaaactggatgtcttgacaatacatgggtttctgtttttctgaatgtatagaagctagacataaaagtatatcgaaaatacctctgcattgtgcgatgcaacggaatactctaaaacgcgtcaaacctgtcaaatgcattatattggtttatatatctgtaggatggtttatagaagatgtatattatattcagtgaggagttttataccttgttttcctgttttgtagaagttgataacatagcaaacgatgtcgcgggagaatcttgtgtggctatagatccgaattcatcatcttgtttcagtagctgttgttgagggtagttcagcatgatagatggtaccgaggcttgcctcccatgacttgttaacaaagagagaatagagaagactttgtttgtcactgagaatgctgacatgttaatagtatctgtgaaggtaaatttcaaagatacaatggcggtcagatctgaacttgcaggatgtcacggatgcgacgagcttcactaggagtcatagatgatggggcacaacatgcattgccttgctctgccaatataaatttatcaacatattctaatccatgttcgaaacccttttccccacttagattctggtgatgtgtctaacgacagtaccaaaaatacttacttcttttctttgtattgtttggattagaacgctccatctcatattagaagttataaacttgcttatcacaatgtttctatcaatttcagatgtatttaggttatgaacctgcacttttctaaaaatacataattatattgagcataggctctattgcatagaaaaatatgattgtggcccacaaaatcaaactttaatgtaccaatcgtgcatgatgtaatagaggtaaaagacgtggatgacagataagctacactatatgatacctaacttgttgctaaaacacataggcacatgcacattgctaagaatcctaggatcaaattacttaaaatgattggaaaataaaacgatgaatgttttacatagttataggaaaacaagaaagaatcaaagtgtgtcaaacacgtaagctaaggtaacagaatgaaactgtaaaaactctacaactacgcatgaatgatctgtaaaagtttgtgtcaagtacctcgtcgatgaagtcactgaggctcagaggtattgtttcacttgctcgatcccaccaaaaagcatgaattagaagaacctaaaacatgtgtagcacacaaattcagtgtgaaaaatgcaattgcataatcttcactcatagtgcagtggaggaacaacatgaattgaaaaagattaaaattagcattacttacctcgctaaacagatttgcaagggttacacgtaatgttcaatgtgtttagttccaaattgcttcctttttggaacaacaaaggttctagcaatgtatttagaacaaagaattaagttttacgcacatcggtagtaacacattaataaaacattataggaaggatgatctaggtttgtataaaagcatacctccgtgtattagcctgcatgctgactatactgtccactggctataggagccgatctgagaaaacttatacatttttacatgtaaaacacgaggaaaaattgatcttgaggaggaactggcaatgcaaattatgtgcagcacaacatagtggggttggaaatccaaaagaaggcataatgaaaatgtaggagacgtatcagatatcggatggaaacgtgtttgagtaaaatataagagtaactccaacaatagccctaagcaataaaacaaattgaaatataaggcctaaacaagaaaggtgagctccaataggagcctcattttaataaaattcatttaaatgttttggggctcaagctaaagagtattatatttgggactcacaaacgcgcggcccaataatgttcgcggtatttccaacctccactagatatttcacggagacaacttcctcgccgccaccgatccagaccgacgcgtccaccccaatctcatctctgggtcaccccattcgtttctcggtgacgagccaccgaggaagacgatcgtcccctttccatcttgctcgccttctctccatcatcctgcttccccgtggtttgtctcccagctcctctcttgatttgctaggctcttgtctattatctcacatctcccctccccttgatctgctaggtgcttgatggattgaagtctgccatccccacggtcgcaggcgctaatgagggcttgacgattttctggaagcaaccggaaaaaagctaggcgggaatgacgtgcaaagtgggagagaaacagagaggactacgtacaggaacatgaggtagttgcaaacgtaagccattttagggtccatgattggaattgacaattgaatttgaaccataaaacaaatagaataggtagtaaattaaattatagagcctaactataaggcttatggttggagttgctctaaggacgacagaaaagggacatttagagagttaaacacaagctagaagtaataagattatcctaattaagtttcacacataaacacactatctaatttatcaatgttgtatgttttgttttacccaaaactgtgtgtaataaaaacagattgggattgatacaacatcatgaattgtaagacaaacattatatacggttacacataaacacactgtctaattcatcaatgatgtatgttacatagaatgagattggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctcggaacgcacacaccgcccggtctccgatctccgatccccgatcccctcgtcgatccaaggtacggcgaccatcctcccccccccccccccccctctctctctgccttctctagatcggcgatccgatccatggttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatcttcgtgaagactctgactggcaagactatcacccttgaggtcgagtcttctgataccattgacaatgtcaaggccaagatccaggacaaggagggcatccctccggaccagcagcggctcatttttgccggcaagcagctcgaggacgggcgcacgcttgccgactacaacattcagaaggagagcaccctccacttggtgctgcgtctcaggggtggcatgcagatcttcgtgaagacacttactggcaagacgatcacccttgaggtggagtcctcggacaccatcgacaatgtcaaggccaagatccaggacaaggagggcattccaccggaccagcagcggctcatctttgctggcaagcagctggaggatggccgtacccttgcagattacaacatccagaaggagagcaccctccacttggtgctgcgtctcaggggtggcatgcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattatgaataagctgtcagttaaaagtctgctaaatagggctgtttccggttatttctcttgatgttgcgtgaggatagatttcttcagctggtgttcatcagacatccagattcgtgaggacagatttgttcagctggtgtttgtgtttcattagacatccaagtgtcgttcctgggcagagacgccccaggttcctcggtagacgcaagaacttgtctagctggtattccatgattccatcagacactgtaggcccccctacagtaatttttacttcaaaaaaatgattccatcagacctcccgtttcttactagctaaaacttcagttcactgaatgctattagctagctacaggatctgaaaagctcggtcctttagtccggcttacacttcgttgcagcgctactgggttctgatcgctggttcttgctaaatccaaaatatcgcgtaggattgtatttctttctggtggctgaattggagggcaggctatggcttcatgttttctcgagaaaaattggctgcaaggtggtgaccagctgctgcctgctcatcagccgagtgcacgcagccgcaggtgatgcgcaattgcgcatgctttgcctacctcacagtcacagcttccatcccctctcggtaaaagaggagctgctgcatacagcgcgtggcccaagaaccgagaggatgcctgaaggagatcttcgctttttgatcggctcactctttctccacgacagagcccgttgatcgaccagtctcatcacaagaccggcccacgcacagaagagtgacgattgtgcgtcggtgacgtatacgccgcatggaaacgagaacagtgcagcgaattaattaattaagaagatgatgacctgaaagaggcgatgatgagccgctgaaagttgcgcagaagaggccggggccagccagctagcgagctagggggggctttgaggccatggcaggaaaggaaaggaaaggatcatgttcttttcttgctctttcttccacccactgcagacgccgacgccgatgcctcaacctcaacaaccgcaaccatggacggtgaggactgcaaaagagaccgcacgaatcgcattcctggtgggcacacacgcacacgtgctgcctggctaggactagctaggagtgggcgggtgaaagcgctgcgaaacttaaccgggatgcagcttgcggcctctaccatcatagctcgattcgatctctactgctgctagctgctgctgcaagaaaccctatcgaatccccttttttttatctgaacaattcgatcagtattaggctattagctctgcaaatgtcagtgtgttagttaagcaagctcgatctggagtgtgtgtgtgtgtgtgtatgtaggcccaacgcaaaacaaagaaaacattccatgtatttatagaccatcgtctcgtcccagtccacagacctgtgtacactcgtactcgtctcttcttcgccacacacacacacggctgctagtgtacacagaggcacagcagcaggaggatggccgtagtgccggcggcgccggtggttcttggagtggccatggtgctcgtcgtcctggccgccagcgccggcgcggccgggcagctcaggatggggttctacgccgagagctgcccgggcgtggagcgcgtggtgggcgacttcgtccggcagcacgtccgccgcgtgcccaccgtcgccgccgcgttgctccggctgcacttccacgactgcttcgtcagggtacgtgcgtgcgtgcgtgtgcgtgtcagcgtgtgcgtcgtccattgcgtggcgtggtgccagcctgaccgcgggtgtgtgcatgtgtgtgatgtgtcccaccacgcgctcgctcgtcccagcagggctgcgacgcctccgtcctgctcaactccaccgccggcagcgtggccgagaaggacgcgccgccgaacctgacgctgcgcggcttcgacctcgtcgaccgcgtcaaggcgctcgtcgaggatgcctgccccggcgtcgtctcctgcgccgacgtcctcgcgctcgccgcccgggacgcggtcgtcgccatcgtgcgtgagctagctcgtcactccactttccaccacgccacttctcgatctggtggtgcctggacgatggatggatcgtcgtcgaccatgcacgtacgtacgta

SEQ ID NO: 28 - DNA, 1570 bp, Zea mays
  gene (1)..(1570)
aactcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcattcctccggaccagcagcgcctgatctttgctggcaagcagctcgaggacgggcgcacgctggccgactacaacattcagaaggagagcaccctccacttggtgttgcgtctcaggggcggcatgcagatcttcgtgaagactctgactggcaagactatcacccttgaggtcgagtcttctgataccattgacaatgtcaaggccaagatccaggacaaggagggcatccctccggaccagcagcggctcatttttgccggcaagcagctcgaggacgggcgcacgcttgccgactacaacattcagaaggagagcaccctccacttggtgctgcgtctcaggggtggcatgcagatcttcgtgaagacacttactggcaagacgatcacccttgaggtggagtcctcggacaccatcgacaatgtcaaggccaagatccaggacaaggagggcattccaccggaccagcagcgcctgatctttgctggcaagcagctggaggatggccgtaccctcgccgactacaacatccagaaggagagcaccctccacctggtcgtccgcttgcgaggtggtatgcagatctttgtgaagaccttgactggcaagaccataaccctggaggttgagagctccgacaccatcgacaacgtgaaggcgaagatccaggacaaagagggcatccctccagaccagcagcgtctgatctttgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccg

SEQ ID NO: 29 - DNA, 113220 bp, Zea mays
  gene (1)..(113220)
  misc_feature (9053)..(9152): n is a, c, g, or t
atatgtgcagtctcttgttgggagctcagactcataagcaaacttggccccatggacagttttgctcgtcgcattgatcctaaagcaaatcaagctgaagccaagaggcaacaaaacattaatgaggctctttggaaagagagaacacaccaggtgcagcaatatgttgctagatgggtgtacacacatggtattccattccatgcttgtgacaatgatgagttcaaggaaatggttgaggctattggtcgatttggccctggtttttagccaccatctcaacatcattatagagagaagctgctagaagaggagcatgctagaactaaaagcttgttgcaagaccgtgaagacgagaagaacaagtatggctgctctgttatgaccgatgcttggacagatatgaagaggagaagcatcatgaacatttgtacacataccactgcagggacaagttttatcaagtcaaaggagatgtcaaatgtgtcacacacaagtgaggtcatatttgagttggtggataaagcaattcaggatttaggaccggactcagtagtgcaagttgtcacggacaatgcttctaacaatatgggagctaaggcattgttgcatgacaagaggcctaacattttttggagttcttgtgcaactcacacaataaatttaatgctacaaggcattggcaaccttccaagattcaagaagagaattgaccaagctaaatcattcaccatctttgtctatggtcaccaccgcaccttggcatgtatgagatcattcacattgaagagagatattataagacctggggtaacaagatttgctacagcctaccttactttgcaaagcatgatggagaagaaagatgaccttagaaagatggttgtcgattcaaagtggtatgacttacccgatgtgaagtctaagaagggaaaggaggcaacagcaatggtgttaagcataccattttggaaaggtgtgtcactttgcttgaaggtatttgagcctcttgtcaaacttcttcgtttggtagatggggatgtgaagccatctatgggtttcctctatggagaactaatcaatgcaaagaaggccattaaagaagcatttggaaatgttgagataaaatacaaagaagttatgtccattgttgagaaaaaaatgaaaaacaggcttgattccccactgcatgtggctgcatatatgctgaatccatactatagttacaccaacagtagcatcttatgtgattcaaccattatggaaaaattcatgctatgtgttgagacattttatcatggtgaggacgagaaagcatatagagctgtcaatgatgacttggataggtttcaaacaaaacaaggatctttctcaaaaaatatggcaaggagctgccaacgctttgatttcaatccaggtaatattgtgttgtgaataaagccataaatcatatttgaattgcagctgctccttgtttcatggtttgaggcatgacatttcttcattatagcatcttggtggaggctctatgggggtggagcacctgatttgcaagcaattgccattaggatcctttcattaaccactagctcatccggttgtgaaagaacttggagcgtttttgaacaggtcagattgctccttaactcttaaaatgactttctagtatcaattgtttacacttatgacaaggattgtgatctgtgagcatatttgcagactcatactaagagaaagaacagattaacaacagaacgcctcaacaatcttgtcttcatccaattcaacaatagaatgttgtccaagaaagagagaatttcccgaaacaagaactatgaggtgctcttgagttctgattgttcagaagctcaaggatttttctttgagggaggggatgaacaagcattagttcaaatcagggatgaggatgagggagaaatgcaagggacaggtataccatggtctgtcctaggagatgcaatgggagtagaggatgagctacaacctcgcaggagcgcaagagtggctagagaggtggacgaagaagattgggaatctgaaaaagaagatgaagacaatgtgcatgaggatattgattatgaagaggacaactgtgagatttcaaacaccagtgactatgtccatgtgaagtaatggtgaattgcaggactgcagttgacctgatgttatgtttatcagtttatttgaagtttgaactaatctaagtttgtaatatttatattgctccactgcgctactagtgtgttgtgtgtcatgaactagtctattatctatttgaattagtttaagtctgctatgagctgttaatgtttatttgtgaattgtgattatgagatttttcttatatttgtgttgttgttgtttggtgaaaggctgaaggaaagaagatgagaagaagataagtttcttttcttttagtcttcttgttgatttgttcatctcttttacagtttaatctattgtttgttgatttgtgatgctgctgctgtttggtgaagggctgaaggtaagaagctgggaacgtgcagcaaggctgcaaaaacatgtctattaatccaggtaagtacccataatttctaggtaaaactgtttttctgtgcaaatatatattatattgtaatattcctacaaacgcttaagcacgattaatctatgcttaagctttataggcgctaagcagtggcctaacgcccgcctaacgcctagcgcttaatataactttgatatcaagatgtccaaaacatctatagagtcattaacatagtcataatcataatcaaagtgtgaatacaaaacgtagtacaataagaccctcacaggagctgactggggtttgacactaaacacatctagaactcgtcgaagtcctaaaactcctgaaagtcctccatgttgtcttcatcttctcgtgagcactgattgcaatggggacaacctggggttgggtgttttttaaagcaagggtgagtacacatcaacgtactcaacaaatgtctcgtttggctaaagtgggctagctgtatgtggagttaagcttaaagcggtagcttttagttgatcaagtgcatcaacgcaaaacaacttcgtgaagactgcatggtcgtgtcacacccggttttggaaggtgaaccgaatgcgaaccatgtatgtgccaggatcagaaactcacgtacacaacgattacataaattggacatcatcacacaatgcttgaattaaatacggagaggtacttagttacatcaagatgtctgagacatccacagagtctattacataatcatcatgtttaacaataacatcaaagtgcggagtaacgaaacatagaatgtaagcctacacaggcagctgactaggggtttgccactaaagtaactagaactcgtcgtagtcctgcaactcctcaaaatcttctatgttgccagcttcacctcttgagcactgagtacagtggggacaacctggggtggggtggtttgtaaagcaagggtgagtacacttcaacgtactcatcaaatgtcccgtttggctaaagtggactagctgtatgtggagtcaaggttaagcagttgcttttagttgatcaagttttattactataagtagagccaagttttagtaataacccagttattacccagaggcacttcctccaagaggaaataccagagattagatttataatcatcattgctattcatcatcataaaagtaaccaaagttcttctaatcgaagaggatcccaaggcagctcttaaccgtgagcacggctgatataccagtttctaacactctacagaggttgcacagtttacccacaagccgtgattcccattctgcccggggttctagcctccccattgatactaccaaggtgacctagcagggtctcaatacgtagcctttacaaagatttcccagaggtcatagccgcctgttaggtttctccagtttgataaacacagtacatctccccaaaggtagggtgactaacaaaaccaaatcaaagaacctctgcaaccaaccttggcagagcaagtactgtgcctggaccccattgatggccctacggcgaagccaactactccactggttcctctaattaatcagctaagggcgtcccatttcaccctcatggttgcactgttatcccgggttgtcactctccaaacaggtccttatagagaggcactcaggaaatagcctaagccccctaaagaatcataagaacctcattgggataacatcattgtatcataaattatcacatcatgttcattgattaagttagagcaatagcataagctaaccatgattaacccaaaaaggtaaacaagggcaaggaaaatacagactagtcaatccttaagttttaataatgtaatgcgggacagtgaattataaagtaaagtaggacatgataggtctgaagacactttccttcactaggttgttgctaagagggatcttcggcaacacgctcaggaaccacgagctgcttgttatctaagtaaagcgagcatacattcaatacatttggaaagtaaaaattaacaccacatcacacatgaacaaacattggcacacaactcaaaaaggtatagtattaagtacaggggaatgagatcaaattataaaatggactaatcctaattggggattaattactctctaagtgtttggaacatggttcaaaaaggttaagaggtaattaaacaagtagagattaaattataagaactattcttatttaggaattttattatcctttaagtgtcatccaaaattacatacctaattatatttatgtcattaaggactaaaggttaatccaaaaaatgaatccatgaaatgcataacactaatctcacaaaattaaatatgttttaactcctaggattctccttttatttatttcattaaataaataaataaatcaacatatactttaattctatattctaagtgtaaaaattaaagtatacatattacagttggtcatattttatttggacagagaataatcttgtgaacattttgcaatttgaatcactaaatttggagttcatatgaaataaacaagttttgaagtttgaaatatgaaattaggactaaatctatgattaaataaaagtccaaggggctattctaaagaaaccagggacctatgcgctaaaacagaggatggcgggttgatttcctaaaaccagggggtttcttaagcaaaacaaccacgcgaaggggtacggggtaacctcagccgtcggattagacatcaacggcccagattagatcacgcaagcgcgcgcgggcgcggctgacaagcggggccagggcaccagcgagtcagggcgggctgaccggccaggcccaggggcagagacgcgggtgagggggagaggggaaagacggttcgatctggatcagagggctacgatcagatccactcgggttaagtccagaccgcccgatctcaggtggacggccgagatctaacggcagggggtggacttgggcgcggtggcgcgactcggtcccgcggcgagagctcgccggagacgaggaggctggccatggcaggactccagaggcttgggggtggttcaggcgtgttcagggtgatctggcgaactcagccaagggcaccacgctggcgcaggagcaccagaggggatacacgcggaaaggcagactaacagcggcgctagattgctccggcgagcaatcgcgcgaacaacagggcagtgcacaggaaattagcggcgcaagcatgtttctcacctcgaggggaagtgatggagtcacggggctacgacggtggagcagggacacgacgtacgacggtgggggagctccggctgcgcgagaatcactcaggtgaacgcgggtcggctgaaccagggagggaaggggcacaccgaaggatgtcccgagcaactaacagtgaggcggagctcaccgtggcactggacggggcacgaatgcgacagtggccgcagaataggcggtggtcggcggcgggcggtggcggtgctctctacacgcgtgggcagagcaagagagagggcgagcgagtctggctgagggcgcaaatgggcgaggggaggtgggcgagtagggcgcggggctcaaaaggggcgcgggggctcggacgtggccggacaacgcgcggtcgtgggcgcgtccatggcgggagatcgtgggcgagaggttagagacgagctgacaggtggggacggcggggcagagagagggagagcgggcgcacgcgagagaactagagccgacaggtctggcccacgggacagagagagagagggagagaagcgcgctcgggttggcgccaacaggcgggacccgcctgtcaggcagagagggcgcgcgagcgcgggcgcacgtgctgggctaagtgggctgccttgggccgaattagcttttcctttttcctaaaatttctaattgtttttctatttattttctctaggctttttcattcaaattcaattcaagtttcaaattcaaaccaaatcaaatatttgaaacaattcaaagaatattaggctcaatatgatgcaacatccatgactcatatgtttgggaaaaaataaaataaataatccctcactaatacaactaactctaattaaaagagaaagagagagagaaaactagagaaagaaattagagtgagatagagaaaagtaacacctgaatttggatggtcataagaaagaaattttatacccccaaattcagggtgttacagacctatcccccttaaaagaatctcaccctcgagattcaaggctagctagcaaagagttcagggtacttggctctcagatcatcctctcgttcctaggttgcttcttcttctgagtgatggccccttttgactttgcacatactgatggtgttcctccgagtgactcaatctgctgtctccagaatctgcgttggcttctcaacgtatgtcagatcctcttgaacttcaagatcttccgctagcaactactcttctagtactcgcaagcatttcttcaactaagacacatgaaacacatcatgcactatggacaggttctctagtaagctgagttgataagccacttctccacgtcttacctgaatttgatataggccgatatagcgaggtgctagcttgcctttgactccaaaccttttggttcctcttatgggtgacactttcgagtagaccacttcaaaactgagttcccttcttctggtgtccgcatagcttcactgtctggacagcgttgccttcagattttcccaagccatctagatattctcttcggcttcaagcaaaatctctggaccgaatacctgcctttcgccgggttggtcccaatgcaatggagttctgcaattcctcccataaagcgctttgaatggtgacatattcaggctggcttgatagctatcgttgtaggagaattctgcatatggtagcctcttgtcccaacctaacttgtcttgtaaagcacaagctctcaacatatcctcaagaatctggttggttctctcagtctaaccatttgtctgcgggtgataagctgaactgaatttcaggtgtgtacccaaagcttcataaagttgctgccaaaaatgagagttaaactgggtgcctctatccgatattattttctttggaataccatgcaagcacacaatctgagacatgtataattctgccaacactacactgttataagtggtcttgactggtatgaaatgggccatctttgttaaaacggtccactactacccagatggagtcgtaaccggctcgagtgcagggtagaccgactataaagtccatcccaatctcatcccatttccactgcggaatctgcaatggctgcaacaatcctacgggtctctgatgttctgccttgatcctctgacaactgtcacatctggccacatactctgctatctctctcttaataccgtaccaccagaatctcttcttcaagtcttggtacattttctcgctaccagggtgtatagaatatgctgtctcatgagcttccttgaggatcagttcccagatctaggtgatgtcgggaacacacaacctatccttgaaccataccaatccttctgcatcttcatggaaatctggacctttcccatctatgattaactgccagatctcgttgatcttctcatcatccctctgacctttcctgatgtcttgctctagggtgggttctagctcaattgtcactccttgagtgttgttcggaaatccgaggctcaacctgtcgaattccttcgctagctcgaacgacatcaagtgagcggccaacatgttgacttgactcttcctgctaagagcatctgcaaccacatttgctttgcctgggtgataatgaatctctagctcatagtctttgatcaattctagccatcttcgttgcctcatgtttaactctgactgagtgaatatgtacttgaggctcttgtggtccgtgtagatatcacacttctgcccataaagataatgtctctaggtcttcagtgtatgaaccactattactagctgcagatcatgagtggggtaattcttctcatgaactttcaattgtcgggacgagtatgccactactttccattcctgcattaacacacatcccagtctggtgtacgaagcatcacagtatactgagaatggcttgtgaacatctggtaaaaccaacaccagtgatgttgtcaacttctgcttcaacatctcaaatgattcttggcacactggggtccacttgaaatcaaccttctttgctagcaaggctatcattggtctggaaatcttggagaaaccttcaatgaagcgccgataataaccggccattccaatgaacctcttgattccttggacatcttttggtgctttccagtccagaatcgttgctaccttctttggatccatagctagtccgtctcggtttataatatgacccaagaatagaacttcgttgatccagaactcgcacttgctaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatagtttgatccgtttattttccaattgttcaagtcagtttccatgttatcgtatttatatgatttatataattcatatgcttaagttctcatgatcccatatgttatgtatatatttgatgtcatgattaaattatattttatttgtcatcatcataatattaattaaatggaatttaaaatgatacgaaaaatgcctataagtctaacaatccaaaaacctaattttaggcatttttctgtcagaggttttgctgctgtgctaaagcctgatccttttgatggtaaaaaacttcttgatatggaaagctaagatggaattgtggctaactgcaatgtcttgttttcatgccgctgagggcaagcctgccaacttacctcctgaggatgaggctaagttcaaggctgaagacaacctctttcgaggagcagtaattagcgcactggatactaaattccagaaaagctatatcatccttcctacagggaaagagctgtgggatgcacttgttggaaagtttggagtaactgatgctggtagcgagctgtatctcatggagcagctgtatgactacaagatggttgagaaccgatctgtagtggaacaggctcatgagtttcaggcactagctaaggaactcaaactttttccttgtcctttgcctgacaagtttgtggctggcggtataatcgccaagttaccaccttcttggaaggactttgctacctctctcaaacataagagacaagagttcaatgtggaagagctcattggtactcttgatgttgaggaaagggctagaacaaaggacagtggaaaaggtgttgagacctctactgctaatgtggtgcagaagagaaacttccgcaagtttaacaagaagaaaaaccagaacaaaccagagaacgcgaataaacctgttcaagcagcacagtttaaaaagaagaacaacaataacaagggaaagggaggatgctttgtctgtggcagtgatcaacattgggcaagagagtgccctgatcacaagttcactcaagacaagaaatcagctaatgttgtaaccactgaaactgaaggtggaacatctgggtatggtaattctttaccatttgttctttcagtctgtaattcacctgagtggtggatggacagtggtgcaaacattcatgtgtgtgctgatgcctctatgttcacttcctatcaggtcgggaggtctggcgccttgttaatgggaaatgggtcgcgtgctcatgttcttggtgttggtacggtcattctgaagtttacttcgggaaagacggtgccattgaagagcgtgcagcatgtgccctctatcaagaagaatctcgttagtgcttcgatgctatgtcgagatggatataaagttgttcttgagtctaataaatgtgttgtgtcgaaacatggtatttttgttggtaaaggatatgactgcggaggcttgttccgcttatcactacatgatgtgtgtaataaactagtgaattctgttcatttttctgatgagtcagatttatggcattcacgtttttgtcatgcaagctttggctgtctcatgcggtcagcaaatctaaatttaattcctaaatttaacttggtcaaaaagtctaagtgccatgtgtgtgttgaatcaaaacaaccccgcaagcctcacaaggctactgaggcgaggagtttggcacctctagaacttgttcattctgatctgtgcgagatgaatggaattttgaccaaaggtggtaaaagatactttctcacttttatagatgactccactagatttttctatgtgtatctcttaaaacaaaagatgaagtgttcaattattttaaggcctataaagctgaagttgagaaccaacttgagaggaaaataaaacggttaaggtctgatcgaggtggagaatatttctctaatgtgttcgatgagttctgtgtggaacatggtattattcatgagaggacaccgccattctcaccacaatccaatgggattgctgaaaggaaaaaccgcactctaacagatttggtgaatgccatgttgagtacagcgggattatccaaggcatggtggggtgaggcgattttgacagcatgtcatgtcctgaatagagttccaacaaagaacaaagagatcacaccattcgaggaatgggaaaagagaagattaaatctctcatatttgcgcacttgggggtacttggctaaagtgaatgtgccaatcaacaaaaagcgtaaacttgggcctaaaactgttgattgtatattccttgggtactcttttcacagcactgggtataggttcttaattataaattctgatgtgcctgatatgtatgttgatactatcatggaatcaagagacgcaacattttttgaaaatgagtttcccatgaagaatacacatagtgatacaagtcatgagactataattccccatgagcacgaaatgtcgattcctatagatcatgctaaggattctcacgtgcacatccctgaggaggatgacactatagtcattcgaaagagcaagagacagagggttgcaaaatcctttggtaatgactttatagtgtaccttgtggaagacacaccaactaccattagtgaggcatattcctctcctgatgctgacttatggaaggaagcagtaaggagtgagatggaatctattatgtctaatggaacttgggaggtcgttgaccgtccttatggttgtcaacctataggttgcaaatggatcttcaagaaaagcttaggcctgatggtacaatcgagaggtacaaggcaaggcttgtggccaaaggatatacccaaaaggagggtgaagatttctttgatacctactcaccagtggctcgattgactacaattcgcacattaattgccgtggcagcctcttatggtcttatcattcatcagatggatgttaagacaactttccttaatggagagttggatgaggagatctacatggatcagccagaagggttcattgcggatggtcaagagaacaaggtgtgcaggttgataaaatcattgtatggcctaaaacaagcacctaagcaatggcatgaaaagtttgataatactcttacagctactggctttgctgtaaatgaatctgacacgtgtgtgtattatcggtatggtgggggtgagtctgttatgctatgtctttatgttgatgacatcttgatctttggatcaaatcttaatgtgattgaggaagttaaaaatcttatatcgagcaatttcgaaatgaaagatttgggagaagctgatgtcattctaaacatcaagcttgttagagaagctgatggtggggtaactttgttacaatcccattatgtggaaaaggtattgagtcgctttggttttagtgactgtgatcctgctccaacaccttatgaccccagtgtgctattaagaaagaatcagagaatagcaatggatcaattgacatactcccagatcattggctcgctcatgtaccttgcaagtgcaacaaggccagacatctcttatgctgtgagtaagctaagtcggtttgtgtcgaaaccaggagatgatcactggcgtgctcttgagagagtgttgcggtatttgaaaggtactatgacatatggtattcattataccggaaacccaaaagtgctggaaggctattgtgatgccaactggatttctgatgctgatgagctttatgccacaagcggatatgtgtttctgtttggaggtggtgctgtttcctggaagtcttgcaagcagactatcttaacgaagtctacaatggaagcagaactcgcagcattagacactgctggggctgaggccgagtggcttcatgatttcctattggacttaccggtagttgaaaaaccgataccggctatttccatgaactgtgacaaccaaacggtgataacaaaggttaacagttctaggaataacatgaagtctacaaggcatgttaagaggagattgaaatctgtcagaaagttgaaaaactccagagttataactgtggattatgtccacacatcgaataatctggcagatcaattcactaagggtctatcacgcaatgtgatagaaagtgcatcgagggaaatgggtatgagacccatgtgaaatctactctagtggtaacctgctctatgtgatcggagatcccatgaagtagagtggagaaacaagctaggagtagattgtgaggaaagatcccttccttaactcatttctgatgcacatctttcctatctgtaagacaggatggtttttaccttaatgtattccaagagtcttacaaaggtgagatgttgtcctacagaacatcttctgaggaatacacctatatgagtcagactgctggtcacagtctatgggacttgggtaatccctaaatactcatgaaaggcactgaagtgtgacttatatgcttctaaacagtgggaatacccttttgcagcctagtatcagcaaaggatttgagtgaatctcatttcgcacaaaactgtcaattcaaggcttagtccattgttcagttgtgaatgagtgaaactcttattctagatggatgttcaacttaatagtctcaatcgaaacactggtatatcaaaggattgtgattctgatactttcatcattacaaaccctagagtttggtggggattgtttggatcttttatgggcttggcccatttattgaataaaactctatgggtgtgtaatggtggagaataccaatagtaccacattggaagtccaagggtcttttggcttgacttatatggtgggatttattctacctaacttgagaagtcaagaaatggacaagggcgtgccacacgcgcgcgcgcgcgcgccgccgccggccgggccgggcgaggcgtggcgtggcgaggcaggcaggcgagcgggcgggcgtggtgtggttgtgttaatttttagcactcactaaccgcattaacctttcagttgcctgtctcttcgtcagccgagtgacccttcttcttcagctgaccgactcttggcgtgactcggagagagctggccgactcatggcatgactcggcgagagctgaccgactcttggcatgactcggcgtgacctttctccttcagcttcccctctgcgagaggttaaatagaggagcacccctgtcactcggaacacgcgagaaaacactttcagaatcacagtccagccgccgagtgagggtatttccatctcgtgactctgcgcgcacagagaaacgagagggcaggtgcctccgaagccggtgccgttcgagaccttgcacgggggattggcaattaggtttttggggagcgtctacgcgactgcccaaaacatctccaacatgacaaaagaagctggccaaggatctggatcatcagagcgcatgggagggtatgatcagtttatttacttactgttttgtgttatggagattatatatgtttcatatattcgtctatgttgtttcatatgtaggaatgattttatcttatctgttctgtcttattataatatgatagatctgtctgttttaattttacagtcatgctgtttatgtttctatctgtttattttcaattgttcagtcagtttacatgtttatcgtatttatatgatttatataattcatatgctttatgttctcatgatccatattgttatggatatatttgatgtcatgattaattatattttatttgtcatcatcataatattaattaatggaattaaaatgatacggaaaatgcctataagtctaacagtatagcttacttggctgcaatctgaaatattatactccatgccaggccaacattcaaataaatttgccaatacattggtatctagctttgcacgaaggcgagggtcttgatatggaatgtttattgtcatgttagtaaaatatagtgataaaatgatcatatttatatggaaacagattaatcactaatcaacatacatagaattgtaggtccatgtagtggtatttgttttccaacaagaacaaggcatcactgtatgcgatcattctgaacagctatgttgaagcaatccttatccatcggtttatttacatccaatatatttttaagctcttgaggactttttcttgggtgtacaaatcagtaccaaaaggcaaaaaatatctgagaaggctggttttgtttcatttgtgatattgtgagtgtagtcattgatgatttcttgcccattctgtaggaatcaatgatgaagccatacaagtggtacatacctgaagaaatctctccatagcaactcaaacattaacctatttgtcccagcatcagttgtgccatcattattcatgggtcttgacccaaaaggaattgctctgggaagaagagaatcacttaatcatagacaaacaaattaagaggaaaacaagttaaagcccagaaacaataaagcatggcttaattacttaccctagagttgtcctcgctttggtatcctgaacctagcttttcacaggtcaagagtctgcttcagctattcctgcacctgaggatagctttcaactgttcacctgttgctcgcagggtttagggtttccttgaagaacaaccaaatacgaagaggatgggtgggagatgagaacctttatatcggagacggggagatctggagggtggttggatcggagtgaccagcgccatgcacggaggttgttgggagtaggtatgcacggaggttgttcagcggggaatagcgtgtggggctcggtgctcggggtgtccagcatcggttcctaacggcgcagccgcaggccgcacacaccaactacggcagttccgggaatgacgcgcggggtcaggcttgtggatcgacggagatggcgtcagtgctcggggtggggacgtgcagcgcagcggggatggcggtcgggctcggggccgggggctcggggcccgtcggcgctcgggacggggcatcggcgattggggacactgccgccggttccaggaacatcgcaaggggtcgggatgggtgctcggggtggatggatggggtcggtgctccgggtggatggagggtggtgtttttgtaaaatggtgacacgggcgtgtgagatgctgggttggttgattggaagaagtataggggtttcttttgtaaaaatatgatgcgggacgaccgttgaaactggtgctttaagtatattatagatatataatcttgtcatgaaagaagttgataaatgctttatattgaagggcatcagagtaacaagaaaggcaaataccattatacaaataactgaacttacattcctcatttgtgattctttgtccatttttgtagcaaattgtgctaaagttgtaacacccctggtgttactgtcactaaaacttgagcataacatcatgagcattagcatatcatgtgtttgttacacttagggtgcattcactaggcaaaaatttcaaacaagttgtattgatgtgactggtcatgggtgaaaccctagggtagggtacttaaccctaaacaaggcttaggagtgtcaatacagcctaaatgagagaaaacttcaaaacttatgagaaatagtcataagatatcacctttaatgaaccttgatagcaccaaaaccctaaaaagaccactgaaaaccccaaatgtaaattttgaccacttttggatctcagtgcaaaaaacaaggtattagggtaccctaaagcataaggttcacacatttgaggatttccatgtcaaaagatgagatttggggcttatttgcaaaaaagccactctacacctctcatgtgactaagtctgaaaattagtgaacatggctggctttggagctctgtagttttaaaatacaaagaatttgcctagggtcaacacatcaaaagtctagagctgtaataggagcacaactttgcttaagtgattaagcattgttaacatacaaaaattggagataatcagccctgaagtctggatgtcagactaagactccattatattcagagaaggcagtagattggatcaactttgggaccttgtggagctcgatttgatggatgtttaaccaaaacctctgtgacaaagttaaagctggtttgttaggctacaactttgatacagaatgttgatttggtcaccacataaaatttggagcaaattgcccccaaacaggctctatcaggctgactgaatgagcagcgcgatggtacagtgtccggatcagaacaccagaactagatgcctcaccgccggcgatcatgcacccggatttgcgcccgctgcggtgattcgtgcctagcgcagatggataatgaagaagggtaagaaatatcaccccgtggatgaactccggccactattctactccgatcgtcgtacccgcttgagtcacggccgctttggataggctcgccggagttagccacctcgtgaccctgcgtcacgtgccttggtgctttaaccatgccgcagtgagtcatcttaacccacccgatcatcgcggggtgagtccgccacggtaaatgccaccaatcgcttgcggcagagcacccccttctctccggccgtcgcgcgtctttcccagaattagtcgccaccgctcatggatcctataaattgagcctgccgtcagttccgtaaggtagtccagcatccaatccacccgctcgtgcctccaattactcaccagagagccccaatttgggattttccccaaatcggtctgaaacaccgcgcatagtgacctcaccgtggctagctctttgctctcctgtttgagtacccatatgtcctcctgatgctcctcgacccattcaattaagctagaccacgctagatcttcgggaacacttctgttcatccgtagttcgcgctgtctccatggacagggtgatttatagcccaattccagcaattaagtgaggggaaatggtcgtgtagggttgaattcagtgtccagcaaaggggagagctagccgttgagttatccgaccggtgcaggctcgccggagctcggcctggcacggttcgccgtcgaggaccgcaagttgtaaagaattagaaagggaggaccttgatgcaaatgtcagtgagacaaaacaatagtgtcgcagactctttcgggttgtttaaaaagctagggtcttctgtgcaaagtcggcaccgcgagcgcgggcgcgcgtgttttcgcctgggcatgggctgacttgggccagtttcggcccaatactattcatgtttttcctttttctttttctatcaggattagagaattcctagaaaattgtagaaaaatgctaaaaatgcaaaaccaattttgctaggctcctaaaattctatactatttaataaaaatagttttatgatttttagtccaaataaggaattatagagtatttaaaatagccaaaacctatactcctagaattttagaaattatttagtaactccgaaaatcactaaactttttggataagctttaaatgttatttagaagccttgggtaaagttgggcatgatttggacaatgtttggtgcctaaaccccaaaaccctaatcttctagttatgcctgtcctaggaactacagttctgactccaaaaaccctagtttcctggagtaccgtgaaggaaaattgtattcaagacctaagataatctaattttattttgtgcattttcataagcattacatgagcattcatggttatatatgtgatatatatagaaaacgaagaagaagtagaagttgaagaagaaagagctacaccaccaccacctaaagacccacctgccgggaactgcttttattttgatatttgtggagcagagcccgactctcctataacacaaggcaagccccggtgcatttaacacctccttgctattttaaaatctttctcacttgcctaatgaattaggtgataggagttgtgtgcttaaaccattgatgcatttccttccttggaaatttaattacccttccttgatcccctgttttataaaaaggtttttcttgtgcttagtcttgctctagaaaaacaaaatgttttgttttgataaaagatgatgcttcaagtaggaaggaatgtttttaaaaataaaactggatggtggatccgtcatggtcgtgatgggttcaacatcagaaaagatgtacctctgttaggtaccaaactttgggttgaaatgataaagctgaggtcgggcgggtgacttgcacgagaagagagtctcggtgtagtgtctctgtctaagtcaattaaggaccgtctcgatataggcttgatgatcgaggaccttttaactggtcacatgcctcatcatgggtaagcttggcctcgggcagacaaatactagaataagataacacacaatgggagtggagagatggcgagagtagcgtgtaccctctgtggcaagaggctggacggtggtgtatctgtactcttggttggcgtgaacctaatctggtcttaagaaccccggtggcgagttgacatatgcaagggttaagtgctacatatgtcgtgtgattggagatccccagctgggtacaaatcgattcggatcgccgttacttcttggacatgaagacttggtcactgcactacacgtagcattccagtgaacaagaagggttgacaagtgaaagggaaatttgcccttgggaaatttctataatgttttggtgattaagtgcccaatacgtttaattaagttcctatgtgccaaataaagagagaagtgaaaatcaaggcaaaaggtatgtttctagacttggtgaattgttttatggactaacatggttatccaagtgctagaaacagcgactaaagaagaagagaagggaaaagcttggctgtgtgcagcaaagttcaagttttgcctggcacaccggactgtcctgtggtgcaccggacagtgtccggtgcgccaggctggtccgcgtgaaaaggccgctctcgggactcaacggcggagtacggctataattcaccggactgtccggtgagtcatccgcggcgaactcgtcgctcttgggaaacgaaaaaggcgacgtggctataattcaccggactgtccgatgagccaatggtcgccagcgccaacggtcggccgcgcaatccgtgggcgacgcgtggcagctccaacggtcggcagggggcaccggactgtccggtgtgcaccggacagtgtccggtgcgccaacggacccggagctgcaacggtcgtctgtgcccaatttggaaggcaatcggcaccggacaggctacagtagctgtccggtggcacaccggactgtccggtgcgccactcgacagaaggcaaggatgaccttccaagtttgcctccaacggctcctagctgccttggggctataaaaggggacccctaggcgcatggaggagctacccaagcattcactaagcattctaagactcccacactccgcctccgcgcatttgatcgattgtgttagtgaattgagctccgttctagttgtgaactctttgtgcttcgtttcaagctcaagtcttggcttgtgtgcgtgtgtgtgctgcggatttgtgtgtgttgctctccaaccttactcttgtgcattctttgtgatcaatattgtaagggcgagaggctccaacttgtggagattcctcgcaaacgggaagaaaactataaggaagaaagccgtggtattcaagttgatcattggatcacttgaaaggggttgagtgcaaccctcgtccattgggacgccacaacgtggaagtaggcaagtgttacttggccgaaccacgggataaaatctcgtgtctcttatgattgctttctctttaactatctgtgttcgcaagagctcgcctcatagacttgattaactcgcactaatatctttataatcaagtttgtgggaatttagtgtttggttttacaggatcacctattcaccctcctctaggtgctctcaattggtatcagagccgtactcttcatctaagggactaaccgcccgaagagatggatcctaagggaaaggggatggtggtcaacgacaatgagaaggagtccctcttcaacgagccaagggacgacaagcccactgactcaggatcgagtcacaagaagagggacgggaagaagaggtgcatcaagaagataatttactacgacaacgacgcctcctcttcttcaccaagagacaacgacgacgatgactcgtcgaaaaagagaacggttaatcaaaactactcttttgactattatcgcatgccgtacaattcaaatgcgcatttactatctattcctctaggaaaacctccacactttgatggagaggactactcattttggagtcataaaatgcgtagtcatctattttctctccatcctagcatttgggaaatagtggaaaatggaatgcatttcgatagtacggataaccctgtgattattaatgagcaaatccataagaatgcccaagctactactgtgttgttagcatctctttgtagggacgagtataataaagtaagtggcttggactatgccaagcaaatctgggacaccctcaagatctcacatgagggaaatgatgctacaattatcaccaaaatggaactggtggaaggcaagctagggagattcgccatgatcaggggagaagagccaacacaaacctacaacaggctcaagaccctggtcaacaagattagaatctatgggagcacaggatggatggatcatgacgtcgtccgactcatgctaaggtcatttacagtaattgacccccatcttgtcaaccttattcgtgaaaatcccaggtacaccaagatgacgtccgaggagattctcggaaaattcgtgagcgggcgtatgatggtgaaggaggtgcgatatgtggatgatgctcttaatggcccactacccgtctacgagcctcaaaccgttgctctcaaagcaaccagtagcagggagatgctaccaagcaaggtggcacaagtggaggctactggcctcaacgaagatgagatggcgcttatcatcaagcgtttcaagaccacactaaaaggacgcaaggagtaccccaataagaacaaaacaaggggaaagcgctcctgctttaaatgcggtaagactggtcactttattgctcaatgtctcgataatgagaatgaccaggcacaagaaagacacgacaaaaaggagaagaagaagaactacaagaaggcaaagggtgaggcgcaccttggaaaggagtggaactctgactgctcctcatccgactccgacgatgagggactggctgcctcagccttcgacaagtcttcgctcttccccaacgaacgccatacgtgtctcatggccaaggagaagaaagtaagtattcgagatacacctaagtactgttcttctagtgatgaggagtcttctgatgatgaagtagattactctagtttatttaaaggtttagatagagctaaggtagaaaaaattaatgaattaattgatgctctaaacgaaaaggatagattgttagaaaaacaagaggacattttatatgaggaacatgacaaatttattagtgtgtgttgggggccttcggcttccgaaggtcctcaaaaacgtgatttgataatgtttctggtgtgtaatacatgagcaggtaccttcggagtcaaaatcgctgtaggaaaaacacaaggagaacgaaggatggaacagagccaaagctgtgcgcaaggaagcttcggcatgttgactggataaaggaaaccgacttaaagaggaaaaggctatctagaccccgataaattactatagagttattattaaatgcaaagggcttggatgtaatttcgcatgggctgcgacccgtacctataaataggtgaacagtacttcacgctgacttagcatttgcttttgcgtcacgcttgtgcctttgctttctttcaagccgaaggtacacttgtaacttaatgtcatttctatttttccatattaataaaatagaaatgagctgataatgatatgtaaatgttcatgttatctttcgtatttcatgtgtttctcattttcactatcacgtgtcgtaatgacgaaggtatgtccttcatgaccttcgtccgaagatcgttatatcccaagggaaataatgctcagaaggacgaaggacattaatcatttaacctcctttcgtgttgccttgttcttaattcatagcatttgagaacaagtccccaacattggcgcccacctccggtgaaccctttttgaccaccttcggcaaacatcgaccttcgtcatgccgccaaagaaagcttcagcaacaggggctgctgctctgcagccgctggacccgaaccaagagaccctttctcttcgggaagcccgaagccagaagaggaaggccaccagtccaacgcctcaggaggacgatttggaccaagaaatctggaacatggaaatgctgcatcaacaagtgcaaaagaagaaagaaaagatggcccgactagctgacctacaaaggcagatagacgaagcctctgaagaggttcgtcatcttatgcaagatgagcagaaccggaggccctagtacagagagcttcaccaagagggcttcgtcaacgaggatgactggtatgaggatttccatcatggaaattttgcttttgatgatgcttctcctctgtcagcagaaactgcaggctacaccttggccctcgtcttacaaaccacctcagctcccaatgtatgacggacactcagatccgaagcaatttcagatgagctacgaagcaaccatatcttcatatggtggcaatactgcagtcatggcgaagtccttcgtcatggcagtcaaaaatgttgcccagacctggtactcttctcttcggccaggaacaatcacatcgtggcaaaagctgaaggacatgctcatcaccagctttcaatggtttcagacgaagccggtcactgctcaagctttgttccagtgcactcaggatcatgaagaataccttcaggcgtatgtccgaaggttcttacgactgagggcactggcgccaacggtgcctaatgaaattgttattgaggccatgattaaggggcttcggccaggacctacagctcaatattcgccaggaaaccccctcagaccctggaaaagctgcttcagaagatggacgaatatatccgagcagataatgactttcgtcaaaggagggaggaagcttacaggttctccgaaatgaccaggggcttcagagggagaatccaccctaggcacgtcagatctatccattctactcagaatgacgataggggaagtcagcaacaaaggtcgcagtattcctctcaggctttggggcagcaacagaactatcctcggcccccagctccaaggggcagaggcgccaggggcttcggaggaaggtttggggatcagcccaggaaaatttactgcctattctgcggtgaggacaagggccatactaccaggatgtgccatgtcaccattcaaaaacagaaagagatagcagaagttgcagcccaacagagccagctgaagcaggttatgcatactgcttcgtatcactcaccatacattctagagtatgtgggtaaccatcctgcagtttctgttgctttggcaagccaacctcaggcatcttggcaacagcccccacctccaccaccaatgcaacccgcttatccccaaggccagcagccagaagggagccaacacagtcaccagtagagagactttagggagcagtccgaagctcgcacattcaacagtactgtgccagaatcaaagcacatctactaagatatatcctacctcagaaacagcttttacatttgttatcatttaccttttcaataaagaacaatcattgaaaactcagttcttttgttgttttcaatttcttgtaatagcttcgtcattatcataatgaatataccttcttcaaacattgacgaagttctaaaggttttgacgaaggaatgcattgcaagctattgtcgaagcaacaaaagtcgttcttaagggaacgtagcgtaagttttctgctcaaaagacgttccaaaagggaatgcagagcttacagcgaaaaataaacgctgataccgccgaaatagaaggcgaagaagctcctaagggaggcttacagcgaaaactaaacgctgataccgccgaaataaaaggcgaagaagctcctaagggaggcctacagcgaaaagtcaacgctgatacaccgaaaaataaatggtgaggccgaaaaataaacggcaaaaagattgtgtgctccactagggaatgtgtgtgtgcctttggcgcaaatatcattttgcatgtcatttacatcattacatcatgtgcatagcatgatacatcatattgcatcaatggcacaagaaggggatgcaatgttgaccttcggaaaggtagacaatgttgacatacaatattgagctttggagattgtttcgaagaagtgacaaggcacaaaataagttttcaagaaatacagcttcgtcactttgatatgaaaaggagatccattgttcacaaagcataatgttttttcggaaactgtatattttcacggaatatggatattcttcacgaagcatgaaaagaagggaaggtgttttttcgccgaaggctcaaaaatggtatgtacataaagtttcatgcatcgtaaagagttgaattataaaacagcttctatattacattcaaaattacaaaatattacacacattgtctagctaatattacattccaaatgtctttacaataacagctaatctttttttaaaactacttctgcagcttcgtttaatagttgatcaacaactttatccataatagcttcggccagttttataatttcgtcatcctcctttgctctggggtccgccaatggatcagcgggctctgggggaggagaaagtgcggctgcgatgcaaagcgcaaataagttcgaagtcataaaattagaacataaagtcaaaagctattaattaatacctattcgcctctcaagatctgcacttttctcagcggcctctgctacttttctagcgttgtgaatacctttttcacttttccttataatttcttgagccatctcccgaccgccattttcccatatgccggtaaaaaattttccaccaaccaagcttgcttcggccgaggggtcttttatatcttcaatgcataaggcagcctcggtctgcgccagggatttcacatgttcgcagcctctcctctccaagatagcggctatccccctagcacccgagaaggcgcatatgtccccacggccactcaaaatttcttcaaaagcttcggcctcgccgttgatccagtcaattggaccttcgggatctcccagtacgaagttgctttcattcgaatatgcgtcgacgctggcgaaactagtcttaattgtttccacacattccatggattttttatatcatctttcttttgaagaccgaagttctgcagttgttttctcccaatgattcttccagtaatcgctagcgtctcggtcagcttcggcagttgcacactttaatttcgcttcagccagctgtttctgaagattttcaatttcgcacttctaggcttcagcttgggccttggaagtagcttcgtcttcttttattttgttaagcattgaatttaatattttatctttctcaagaccttcgttccttagctcaatcacttcggaacgaaggttattcaatgccatggtatatccttcgtcttcagcgcttttctgcgctctgagggcattgctaagaataaggccctgcaaaaggaatgtggtattaagaaataaacacacgaatttttaaccacgcaaaaagtttattttctcacctttaagctgttgtacgctaagctgtcggccaattcatcttttgacaagactgagagcccatcttctagagttgggaatccaaagcttcttgccatctcccgccagacaaagagctccttgctgtctgggagacaatacaagaagtcttcttctccgctgccattgaatatcaacgcccctttcggatattttaatttctgggcataatgatgagcttctcgcttttcctcttcagatagcattttgccagaagcatgtcgtacaatataatcaggaaatttggaagatgcttcgggagttgaagaaagagttttttcagacagaatttgctttaaagtttcctttgtattttctccttcagtctccaaggatttctccttggcagactctgaaggtccagtttcaatttcagcctggtgcttcgtagtttcggctccagaggcttttgtttcaatttgtgctttttgagcttcgacaacttctttcggagtagagcttgaagactttattgtctctagtacatccaaaacattaaccatacttttccttttgggggttacaactggacctttctgagtttgtggcactccaacttctgccgaagggcttaaaatttctgatatttttgtcccttcagctttcggctcttcaatactttcagccttcggtgttgcagtcagctcttcagctttctgcgcaggtataggtttttttggcttcagtagccaaagaagcctcgccgacaaactcgggcactatggccggctcaatgtagcgtggccgatgggtaagaaccttcaccttttttctcttcggcgttgactcactaggagcggccgaagcaacttacttcacagaaactgtaccttttcttttctgaccccgtaacgggtaacggtagtcaggatagacgaatccaatagcatcaaaaactctgttcagcctcttctttttccgacctccgaaggccgctgatagcgcattatcttctgtcttggagtatggcccaagcagttcatcgcttgtggcttcaatacatttcagccaatcatcatctggctcgacaaacttaccctcgtatctgaaggtgaacttcatcctaatcagtccaccttcatcagacttggtgatagtttcttttggcatttcccacttttctacaagtggccatactctgaaggctatgtgctcctggattaaatcccttgtcccgatgaaagagcagactacgccgaaggccctctggcattcttcggctgcttcatccatttccaccttcggctttcggaggccgaagcgctgccagatagggcgcataatgatatctttaatatcttctcgtgccttcaaatcgtttttcacatagaaccattccttcatctagtctccaggccatctcttccgaaaagtcggcacgggtcagcttgacccagagcgagcaccgaagctgtaacagccaaaattgttatgatattgctctttaccccagggctccgtctcatatactagctcgtgtatattgcaaaaactttttgcatttggctccaaaccttggctcttcacggcccatacaaagattcccattcttattatcgcttcgggggtaagttgatgcaggtagatctgatatatcttcagaacttcaaccacaaatctgtttaagcgaaaccgaagcccagctttaaaaaagcttcggaagatcacgacttcattatcttcgggagttggcacagtcctctctctgtcatctgccctcacagttgacatgtctcgaaaatatctccccctcatgttatcaagatgactttgtttaatactcgattttctgaagaccgagtggcttggtcgccatggtcggtcttcggagtcttcacctccgctttccacatcataactatcactatcaccagtatcttcagataaaccttccaaaatctcccttgaaatcttctctgtatttgtctttgatattgattcaataaagccaagattcttctcctcagaaaggctcagcttcgtttcagcaatggcttttttatctttagacatcttcggaaatgcttaaaaaacttaaaaagccaagcaagtcttggtgcgcaaagagctaaaaactgagtaagcaagagcagatggcgagaaagcgaaacaaatgacatcacggtcatgacatatttatatgcccagggcattgcaagtggggggtggggtcccgcttgccattgattgttgctattctagcaaaaggaaggtgttttttcggacctccggcttagggccttcgtccatatcgcaatttgaatttattatcctaacaaattaatattgcgaggggctactgttgggggccttcggcttctgaaggtcctcaaaatgtgatttgataatgtttctggagtgtaatacatgagcaggtaccttcggagtcaaaatcgctataggaaaaacacaaagagaacgaagggatgaacagggccgaagctgtgcgcaagggaagcttccggcatgttgactggaaaaaggaaacccgacttaaagagggaaaaggctatctagaccccgataaaattactatagagttattattaaatgcaaagggcttgaatgtaatttcacatgggatgcgacccgtagctataaataggtgaacagtactcccatactgttcacgctgacttagcatttgcttttgcgtcacgcttgtgcctttgctttctttcaagccgaaggtacacttgtaacttaatgtcatttctatttttccatattaataaaatagaaatgagttgataatgatatgtaaatgttcatgttatctttcgtatttcatgtgtttctcattttcactatcacgtgtcgtaatgatgaaggtatgtccttcatgaccttcgtccgaagatcgttatatcccaagggaaataatgctcagaagaacgaaagacattaatcatttaacctcctttcgtgttgccttgttcttaattcatagcatttgagaacaagtccccaacagtttgcaaaaatcccttgccttataaattaagagaaattaaatgttatcctctgaattgtatatttgccatgaatcggtctctagtttaaagagtttaaatgatgaattaaatgctaagctagaggaagtcaaaaatagttcatgtgttgagcatgtcattatttgtaatagatgtaaggactttgatgttgatgcttatgatgaacaccttatttctattactaaattaaatgatgaggtggcaagtcttaatgctcaacttaagacttgcaaaaatgattttgataaattaaagtttgctagggatgcctacactgttggtagacacccctcaattaaggatggacttggttttcgaagggaaaccaagaacttaacaagccaaaaggctcccattctcaccaaggagaaagggaaggcccccatggctagtagtcctcaaagaaaccatgcttttatttatgataggaaaattgctagtcatcctcatcataataagagtcatgttcatgttgcttataatgattcacatgctatgtttgcctctagttttacttttgttcatggtagaagtaggcctaggagaaatcatgttgtgtctcatactcctagaaaaatgtgcagtggaccttccactacttaccatgcttgtaatgcttattttgttcttttatgtaagaatgcaaaagtagttgttaggaaattgggatccaaatgcaagggacacaagacctgcatatgggttccagagactgttttgactaaccttgtaggacccaacaagagttgggtacctaaaacccatgcttaaattctttgcaggtttatgcatctaggggctcaagctggattatcgacagcggatgcacaaaccacatgacgggggagaagaagatgttcacctcctacgtcaagaacaaggattcctaggatacgattatctttggagatgggaatcaaggcaagatcaagggtttgggaaagatagccatcaccaacgagcactccatatcaaatgtatttctagtagagtcgcttggttacaaccttctgtctgtaagtcaattatgtcacatgggttacaattgtctttttacaaatgttgatgtatctgtctttagaaggagtgatggttcattagcctttaagggtgtattagacgacaaactctacttagttgatttttcgaaagaggaggccgatctagatgcatgcttaatagctaagactagtatgggctggttgtggcatcgccgtctaacacatgttgggatgaagaaccttcataaacttctaaagggagaacatgtgttaggactaaccaatgtttgtttcgagaaagatagaccttgtgcagcttgtcaggcagggaaacaggtgggaagcactcatcacagcaagaatgtgatgacaacatcaagaccactggagcttcttcacatggacctcttcggacccgttgcctaccttagcatcgagggaagtaagtatggtcttgtaattgttgatgatttttcccgcttcacttgggtgttctttttgcaggataaatcagaaacccaagggaccctaaagcgctttctaaggagggctcaaaacgaatttgagctcaaggtgaaaaagataagaagcgacaacgggtccgagttcaaaaatctgcaagtggaggagtatcttgaggaagaaggcgtcaagcacgagttctccgctccctacacaccacaacaaaatggtgtggtagagaggaagaacaggacactcctcgacatggcgagaacgatgcttggagaattcaagacgcccgagcggttttggtcggaagctgtgaacacagcttgccacgccataaaccggctctacctacatctccttctcaagaagacctcctatgaactccttaccggtaacaaacccaacgtctcctactttcgtgtatttgggagcaaatgttacattctggtgaagaatggtagacattctaaatttgctcccaaggcagtagatgggtttttactagggtatgactcaaacacaaaggcgtatagagtcttcaacaaatcatcgggtttggttgtagtctctagcgatgttgtatttgatgggactaatggctctccaacagagcaagttgatcttgatgacatagatgaagatgatgttcaggacgcaatgcgcacgatggtgataggtgatgtgcgaccataggaacaacaagagcaagatcagccatcttcctccacaatggcgcatcctccaactcgagacggtgaacaggtacctcaagaagagggacaggatcaaggggggagcacaagaagaacaagtgatggaggaagaagcaccacgggttcctccaactcaagtccgagtgacgatccaacgacatcaccccgttgaccaaattcttggtgacataactaagggagtaactactcgcttaagattagctaacttttgtgagcattactcgtttgtctcttctattgagcctttcagggtagaagaggccttgcaggatccggattgggtgttggccatgcaggaagagctcaacaacttcaagaggaatgaagtttggagcctgatgccacgtccaaagcaaaatgttgtgggaaccaagtgagtgttctgcaataagcaagacaagcacagggtggtgacaagaaacaaggctcaacttgtggcaaaaggttatgcccaagtcgtaggtttggactttgaggagacttttgctcctgtggctaggctagagtctattcgaattttattagcctatgccgctcaccactcttttaggctatttcaaatggatgtgaagagcgctttccttaatggaccaataaaggaggaggtatacgtggaacaaccccctggctttgaggatgacaggtaccccgaccatgtgttcaagctctctaaggtgctctatggacttaagcaagccccaagagcattgtatgaatgccttagagatttcttaattgctaatgctttcaaggttgggaaagccgatcccactcttttcactaagacttgtgatggtgatctttttgtgtgccaaatttatgtcgatgacataatatttggttctactaaccaaaagtcttgtgaggagtttagtagggtgatgactcaaaagtttgagatgtcgatgatgggtgagttgaactacttccttgggttccaagtgaagcaactcaaggacggtaccttcatctcccaaacgaagtacactcaagaccttctaaagaggtttaggatgaaggacgccaagcccgcgaagacaccgatgggaaccgacgggcatgtcgacctcaacaaaggaggtaagtccgttgatcaaaaggcataccggtctatgataggttccttgctttatttatgtgctagtagaccggacattattctaagtgtgtgcatgtgtgctagatatcaatccgactccaaggaatgtcaccttgtggccgttaagcgaattcttaaatatttagtttctacgccttgcttcgggatctggtatccaaaggggtctacctttgacttgattggatactcagactccgattataccgggtgcaaggttgataggaagagcacatcagggatgtgccaatttctaggaaggtccctggtgtcctggagttccaagatacaaacatccgtggccctatccaccactgaggccgagtatgttgccgcaggacagtgttgcgcgcaactactttggatgaggcaaaccctccgggactttggctacaatctgagcaaagtcccactcctatgtgacaatgagagtgcaatccgcatggcggataatccttttgaacatagccgcactaagcacatagacatctggcatcacttcctgagagaccaccagcaaaagggagatattgaagtgtaccatgttagcaccgagaaccagctagccaatatcttcaccaagccgttggatgagaaaaccttttgtaggttgcatagtgagctaaatgtcttagattcgcgtaacttggattgatctatagcatacatgtgttctatgcctttgatcatggtactttatgcatttaaatccattattgtttatttgtggtgctcaagttgtacacgtgatccccggacctcacaagtccatgtgtgaatgatgcacatatttagggggagatgtgctacaacctgaccctttgagactaatttgtttgtttgagtatacttggtatagtctcaaaggtacattgaaagggaaaggtgaacttggacaatgaaaagatttccactgcactccggtattagtgtacttacttccatgttcatacttgcaatcccatttgccttttgctcttaattgacattttttggtgaggcaatggggttaaagggccaataatgatcccgttttggtgcttaatgccaaagggggagaaattaaggccaaaagcaaatggatcagctaccacttgtgaatttcaaaaataatagtatccaaaatactcttattgcaaaatttggtctcttgtgggggagaattttgattatgggaaaagggggagtttttggcacttgatcaattttactcttggaataactctttatgtgaccaaacaagtgtggttgacttagagataggaaaatgaatttgatttgcaaaaacaaaccaagtggtggcaaagagcgatccaaatatgccaaattatagtcaaaaacaatttggtcttcaattgcattgatgttgcacttcttttagttgcttttggatgtgttggcataaatcaccaaaaagggggagattgaaagggaaatgtgcccttgggcaatttctataatgttttggtgattaagtgcccaacacgtttaattaagttcctatgtgccaaataaagagagaagtaaaaatgaaggcaaaaggtatgtttctagacttggtgaattgttttatggactaacatggttatccaagtgctagaaacaatgactaaagaagagaagcaaagggaaaagctgtgacaccccaggtgtcagtttcgtgttatgtcaggagatttgtcctaatctcggacgcttagtgaaaatttctatctttttatcacgtttatctcctttcatcaagttaatcatacatacttcaccgaattcggagctattcgatctcgacgaatgccgaatttggagcctgttaaaacttttatttctcggaacgaatgccaactcaaaaatcattctcaaattataaatctcatctgaagctcattaaatcaaactctcgacggctgttatttgatttgagcccgagtctaattcctcgaaccccgatcgatgtccgactattttaacccgagtccgtcctctcaaacggaatgctcaatatgtcatcctctaatcaactttatctgactcggccaaatatctcatgtccgaaccgaattcaaaaccccgtatcgacaacgattttaaaatgccacgattcaccttcttcgactaaaaatccgaaagccagtcatatcccgagacggtttattttcgaatcatgcgcgaggagttatttccgagcgaattcaaatcagactctcggccgagtaatcgctcaatcgtccgttcgtcggaactctaattcgctctattctccgtagaaatgaaatccgcaggagcatttttattctggaaaatattttagcgtggcctgtttgagtgttttgggctaggcccaacccagcccatttggcccactaggaaaccctaaccctagggcttcttctataaataggggtgctcacttggaaattttccactcccacccctctattttccctagccgccactttcttctctccctgttttcttcccccacgcacagcagcaccttcttccccagcgcgcagggagccgtgctcctctccatggcgcccccctgctccttcttcctcggcgcactgaagcttcccccatggcagcgagctcgcagttgcccatggccagacccctgccctaggcgctcggctcctccaatttggatggctggtcttggtggccgcggtagccatgggagccatgccgagctccctgtcctcttcccgacgcgcgcccctgtgaacctccccagtaggcgctcccagcagccagggcgtcctccccttcttccacctctgaccggcgtcctgcgacagctcctcctccctcggttgctcctccctgctcccagccatggcacccaagcctgcgcacttccctgtccatggcatccgagttccctgcacctagctcttcgatccaaaaacagcagccatggcgctggcctctgcttcctgtgcggcatgctctgctcgccggcgagctcatgtgctcacggcacctctccctgccttctctctgtctccagcgaccagcagcaaggacacccccccttccctcgctcctttctgatgtgcgcgaggtgttcgacacaatgcctgcaaggaagataagttgtcacagcaccatcgacgctcgccgggtatttttgctgtttttgcgcagccccaaacatcgacgtcgttcaccccggtgagaccgcgatgctccttgttcgattccgcatcggcgttattttcatatgattaattgtgtatgtgtgttgttttgttttttttagaggagaggcaccccatgttttgcgtggagaagaaggcaagccgctcgacgctcgtcgatgttcgtagcgatgcacaaatcggaatcgccatcgtcctcacaaacaccgactgggtttgtttatggtgagccgatgcatgtcgttctcaatcgactcgtttaattaatttgaatagatgtgtgtaaaatgtttcggttatgcgcattggtaggatcgcgtttgcgattggagaacaaaaggttatgtgatgtatgcgatttgtagttgtctaattatgttttggtcgatgtggtgcatgtttaaaaattgtattggtatggattgaattttgtggcgaaagaaaaagaagtagaaaagaactcagatgtttttatatcttggtaggaaaattatgcgatgcgttgtttgatgcgaaaaactaagttacaaaatgcggattacgtttgggaaatgtatcgatatgtggttatgcgaaaactatagttgttttatgcaatgtgatgggattcatgattatatagggagtctatttattgatgtgacgagtagtttagaaaatgctagttgcatagaggatgaattattaaaacatgagtatcagagttcatatattagtggtcgtgccacattgattgaagtgtctcgagtgcacgccaccatatggttgtatgcgagacaaggttatgcacatgatgagtctagtaaaagtccatcggtgtcggcatggtttctgttgtatggcggattgatgccttgcttggtcaagtatcgcattccattccaattggataaataaatgtcttgttgatcgattagaggtcttatatgagcgttatcgcagcccaataattattggaggcgagtagcgttcatgaatcaatccttgctaaaattggagaacagtgcgataacataggcacatgggtgctttaggtctttcagtagccagtgtaagtcttatggagttttatgccatgttttaatgtctatatgttagacctcctaaaatatggtgttttaagtgacttgtgtgttaactaattcgagtggagaaatggttaagaaaaactaattaacctgcttcaacccatgtttcgagttacaatgtctaaaatggtttgctaagtcttatacggcgttagccaactcatgttaagtaagagtcgatggcgtaagtgattgtgatatatatacatgtggtgtctcggactgcgttaataataggcaaaccgatgtgtatgtcgtatggcgggctatgccattcctttggttaatcgactcgttagatggctttggttaagctcgtagttatgacgaattacttgttgtagtctaaatgcgtatggttatgatcgtgggtaaaaagtagtagtgctcatgtgatgtctaatttaaaacgcaaattgttgggtgattatcgtgaagaataagttgttaattggttgtagtaattttagtgcactaaatgatttggataaaatttgtaagtctacttgctagtcctcatttaattaatttaactctaaaaaatggtaaagtgctagaatgatttaagtctctagaatacggaaattcttgaattatatagaagctggaatttattgattgctgttttgggctgcacgcattgttttcgtggtgctgtttgtttgataaaccaaatcatgttttctgtagaaaagtcatatagaagagttgtagataacatgattatgttgcttgtactaaaatttgacagtcataaacctgatcgtttaggagttgtgcttttcacaagcccagcacctgaatatgtcgaatttctgaacagatttcagaaattgcaatggttgcttaagttaatgttgaaataagttattggtgatcacaaaaaagttgtatatgactctattatcttacttgtgttaaaatttgacagccataggtctgacagtttaggagttatgctttttacaaattcagtaactgaatctgtccactttctgtacagatttcagaaactgcactgtttgcttaagttaatgttacaatctattcatggtcattataagaaagttttagttgcttttcttatcttgcttgtgttaaaatgtcataaccaccataagcctgatagtttaggagttataaattttacagactggttgctgtgttctgtccaccgtcagaacagatttcgaaaactgtgttgtttgatttagttaaacattgaatcacttcttggtaattataaaagttatgtagtgctttttctgagctttccaaaaagtcttggatcactctttttggtgatctgaagtttaagttatgaatgtttaaagtgagaagactggatctgtccagttctggatagcaaagtcttctagtgtattttatccttagttaaatattgaatcaccttgagatgtttataaatggtgtgtaaacaatttcattacctttccagaaagtctaggatcaatttgtttggatgtctgaatctttagttgtgaatttttgaagttgcaagtctgaatctgtctaaatctagacagaactgttgtgtttccacaattcaaccttgctaagtgttgaatcatgttgtgatgaaaataccaaagtggtagttcactttttcagctttccagaaagtcctagtttgatatttttggactaataattaaagaattatgattaaaacaagtgactactgtattgctgtccaaaaattctgctagtgcttatttgattgttagttcacccttttggctaaaaatggttggttagcactaaaattaatatagacttgccatgactaggcttaataatgcatgtgtgtcatgttttatatgtttcttctctagttgattgtgatataggagtttccatagacattgatgcctatgtcctctattgaacttgtgtgctcggtgatgcttttgcgcaatcaaaaggagaactaatgaaaagccgtgtccaaataaatataatgcgcgtacttgtggtgtcatagtggtgttgcgtaaatacataaaatatttgttgtcttttaatggtgttaatgttgaacgtcgataatgtgtagataactaaagcgaacatgtgattgttacggtatcttccattctattgtttagttcgccactgcgtccttgtatatcttgtgctacttttgtgctactgtcattatattcatacatgtgcatcctacatctcatttaggaccgagagatgatgatcatgcaagtgatgtggtgccaacaacaaggtgcagttggtggacgacctgaagaatgatggacttaaccagtggatgctcgccaagcgagtatctcccccagcaaacactatctaagtgttaaattaaagtcaagccccagttttatacataaccgttatatatgctattttactatacttaatgtttgtaggcttatactgtgcacttaagtgtaggagttgcctgaaaccgtagttgcatgaactcaggattcctttttgagatggatactagtatgccaggtcgagtagctgctttgctaattagggatctcggtagaagtcgagtgatttttctagcactcgcgcgaggtcaggaattggttgtatccattttgataacgaaatgatgatggtctttggacacgggtccatggggacacgtggtctacgagacggaaattggaataaggattaacgtgtggatacctgtgtcaagcgtttgaatgtactaaacacatgccgagaaatatggtaaattggtaagcctagtacctgagtgaacctggcagcagactttacccctcacgcgacctgagacgtggtctcccattccggttatggtgggtacaagtgcggtcactgcacgacggtagtcggggtcagtgaggcattgtacgccaaggcggtgagccctgttctgttgacggggaatcgatgaggacggttgatgtgtgtggggacggagtgcctcgccacgtcgtgtgtttaggtttaccttgcaaggataaaaacttgattcgaatcgtctgcttctcgcagctaatgagactgcttgatccattgtactgcattgagtaataagtggaaatgaggtgactgcaaaaagatgttgattgataaaatgtttgataccatgtatgaatagctaggtactcatctagtttaaaaaggagcatactaaaacttgaaaagctaaaacttgtttttagactcagctagtgcttttggcaaaccaaacccctcagccaaacagctgcatgtctagaggtagaggagtagactcctcacaccgggtaagtctagctgagtattagtatactcagccttgctagtggcacaattttgcaggtactccttgacttggttgatggtgtgacttggcctccatccctgccaccgggatagacggtcaagtgggttattgctttcgcaggagaggaccaggaggagtagcgtggctaggcttcgccatgttactcggttttctccgttagttatttccgctgcattaaaatttatgattgttatttctgaaactccgataatgtaatcactaatgatacttattaaatttgtggtattatgttttattgtatttctctgtgcctcaccttcgtgtgagctagtggtattcgatcctaggataagtggctttatcggactagatctgagggactgacgggttattcctgtttaagtgtgttgctgcccttaaggtgcgacttgggcacttaagctagaataattcaggcaattccaccacaaaagcttggctgtgtgcagcaaagttcaagttcggcctggcacaccggactgtccgatgctgcaccggacacgccaggctggtttgcgtgaaaaggacgctcttgggactcgacggcggcgtacggctataattcaccggactgtccggtgagtcgtccgcggcgaactcgtcgctctcgggaaacgaaaaaggtgacatggctataattcactgaactgtctggtgagccaacggttgccagcaccaacggtcggccgtgcaatccgtgggcgacgcgtggcagctccaacgatcggcagggggcaccggacagtgtccggtgcgccaacgggcccggagctgcaacggtcgtctgtgcccaatttggaaggcaatcggcaccggacaggctacagtagttgtccggtggcgcaccggactgtccggtgtgccactcgacaaaaggcaaggatggccttccaagtttgcctccaacggctcctagctgccttggggctatagaagggacccctaggtgcatggaggagctacccaagcattcactaagcattctaagactcccacactccgtctccgcgcatttgatcgattgtgttagtgatttgagctccgttctagttatgaactctttgtgcttcgtttcgagctcaagtcttggcttgtgtgtgtgtgtgtgtgctgcggatttgtgtgtgttgctctccaaccttactcttgtgcattcttttgtgatcaatattgtaagggcgagaggctcccaccttgtggaagatccccttcacaaacgggaagaaaactataaggaagaaagtcgaggtattcaagttgatcattggatcacttgaaagggggttgagtgcaaccctcgtccattgggactccccaatgtggaagtaggaaagtgttacttggccgaaccacgggataaaatctcgtgtctcttgtgattgctttctctttgactgtctgtgttcgcaagagctcgcctcatagacttgattactcgcactaatatctttataatcaagtttgtgggaatttagtgtttggttttacaggatcacctattcaccccccccccctctaggtgctctcaataagaaaatggctagtataggctaagtgcttgaactagggtagaaagaactctagaattcaggtaatgacttaacttgctaataaaactggatttttaaggatccactattagtaagcatttttgcaaatagagtcttgattattgattaagccctaccttgactcccccaagccagcatatccttgagagtcttttattttgacggataagacttgtgaaagtacacttcgtactcagggttttcgaacccatgctgttgtaggtgaggaagcagcaaatttttgttgcttttgttccaaggtggtgcccaaggaagaaaaccaggattgaagcctcgggaggaagtgtcctcctttaaaaactttttactgttaaacgggaggggtttttgcctcccgggtttgtaataatagtactccagcactcttataatttactggtctgtaataataatactctttctatactttaatataaaataagttgctgtaactgcttccgcatatttgttcctccgatgtgttgtaatatctgcgtgacgggtgaaacgctcttgggcaaggtaaagagttcagataccgaacttgtcaggtgatcaggtgcacctgcagggttgcccgaggtccgatggacaaggacaactgtaggtgggcctaatgacttgggaggttctgtcacagctggtattggagcgaagcccatctctgcagatattatgagacgtttcaaaaagaattttcaaagacttatctaaataaaaaaattcattcttatcttactaccttctgaagtacttatattataagaccaggtaatagagtgcaatgtatagaaggttgtgaatcaacgaaggttgattctgtaattatgcatgcatcatgttaaaaactatactaataaagttttcccccttatggagatatgccgccacgcacgaggaaaactgtcacacccggttttggtaggtaaaccgaatgcgaaccatgtacgtgccaggatcaaaaattcacgtacacggcgattacataaatgactcatcatagcacaatgcttcgaataacaatagagtgtaagaaataatatgaaagactagagtcatttacataatataatcaaagtacacaggatagaaatgtagccaacgtaaattaacccaccacaggcagctgacttggggaggtcgctagcctaaacctcgaactcatcgaagtcctggaactcctggagatctgcctcgatgccttcttctttacctgagcatagattgcaccaaaggtaacctggtgttttgtgaaagcaagggtgagtacacatcaatgtactcagcaaatgtcccgtttggctgaggtggactagctttatgtggagttaaggtcaaagcagttgcttttagttggtcaagtatttattattagtgggagccaagttttatcatataaccaatccatgacccatttcctcgtcgaggaaacatcattatcatcatcgaaccagaataataaatagaaccataggatctcgaaccatctgtatctctaatcaaagaggatcccaaggccgctcataaccgtgagcacgactgatatatcagtttcattccctctgcagaggtcgcacactttacccacaagtcgtgattcccgttctgcccggagatcatgactctccattgatcactaccaaggtgacctagcagggtctcactacgtagcctttacaaagatttcccagaggtcatagccgcccattaggtttctctagtttgataaacatagtacatctccccaaaggaagggtgactaacaaaaccaaatcaataacctctacaaccagcctcggcagagcaagtactgtgcccggacctcattgacggccctacggcgaagccaactactcctctggtttctctaattaatcagctaagggcgtcccattccaccctcatggctgcactgttttcctgggttgtcattccccgaacaggtccttacggaggggtactcaggaaaaatggcctgagtcccctaaagtaattacaagaacctcattgggataacatcatcgtatcataaataatcacatcatgttgattgattaagttaaagcaataccataagctaaccatgattaacccaaaaaggtaaacaagggtaaggtaaatacagactagtcaatccttaagtttcaataatgtaatgcgggacagtgaattataaattatgtaggacataataggtcagaggacacttgccttcaccaaaacagatgctcagggtcttcaactttgtagaactcgaagagctagataacttggtcatcaacgcttgatcgtctttgatccctcgaagctcggaaacagatcgcaatctattcgcgatgcacagcgaatacaaacatgcacaaacaagcaaacatatgtatgcataagaacattacatcattcaaataaaaacataataaaacatgcaaaacaaaatagagagcgttactacggtcacacgaggaaaaagaaatttcgaactcgacagcgtgcaaacgacgcacggacagcgcgacatagcacgctgacgacacatgaaacagtacgcacgaccagcgcgaacgatgcgcgaaccggcacgtcaccacgtgcggaacagcacgcgtgacagacgaggaaaactaaataggtgacacgtttatactaaccaaatgttaaataaatagaaaatagttaagttaatatttaccatgttaatatttattataaaagccccaagtggaacactacatattttaatctagtcagaatattaatctaataaatattagtcgagcaagcctcaagttaattatctaaaatatgcgacccgacgagttaacgttactaacatgagttatagacgaaactaatttattattatacgcagacgtcgcgcgacacatgaactagacgcgtggcacgaacacgcgaaggaaacgtcgacgatacgcaaacagcgtgtgaatggcacgcgaacatgcacgtgataacgtgcaggcagcgcgatagcacgcaaacgatgtgtgacgacgcacagacacacgcgacatacgcacatgacatgagacaacgcatgcgaacggcacgtgtgacacacgcgaaacaacgcgcacgacagcgcgcaacacacacgtgtcaatgcgactacgcgcgcgaaaaacaacaagcaaataataattaaataaaggtatttatgctggtattaatcaaggtaagtacatttatatttataaaagcacaaattgaaactatagactcgttctaatcgaattgttattttattaaccctcgaataaaccaataattaattactcaactaaaacatgtgacacgacgaccacgagcgccacacgtgggaacagcgtgcgcgacaacacgcgcaccaaacgcgtgaacgaacaacggtgacacgcaaacaacgtgtgacgtgagaaaaaggtgtgtgcgacgcgcttcaacagtgcacgaacgacgtgcggcgacacgcacgatccgaacgcgcgacacacgcagacacgtgtgacgacgcgcgcgaaacagcatgcgaaacaacacacgcgaatcggatggcgatgaagcacgtgaacagcgtgcacgccatgcgagaatcactaacgtataccgtactcatattagatatgtaaaagcaatagtttaaaactatgactaggtttacctagcaagctagattaattagcattgattaaacaaatgcttacttaattacctaaagcacacgacatggtgaataatatttttaacgcgtagatgaagttataatgaagctaacgtaacacaaatgggtcaaaacggattaaataacgcgcgcgactgcgcgaaacatcgtaaatgatgagcgtgaacgacacgcggatcagcacgtaaacacgtgcaaaacacatatgcaatacacgagataaactaaataaacgtcgcatttatattaaactaaatattaatcacgccgacagtcatttataaagcgcaagtgaataactataaattagtttaattgaaaagtctaattaattaacgttagttaaacaaaaacgtgagacatggcgaaacgatgttactaacgcgtagaggatgctcaactaggtgcggacatgaatggcgcaacgggctccggcgaggccgtgggtgaccacggggcgagctcgcggcgggtggtgaacggtgatgatgcagctgaccgctacacagcaaggcgaggcgcgatggacggcggcgagaggttggctgatagggcgtagcggggcaagccgtgcgtgaggcgggctcgcccgggtagcgtagaggccatgccggggctgccgtgggcaagccgcgaaggctgccgcaccggctgcaccaggcgagccgcgccatggcggactggccgggggaaagcatagggaggggtagacgaaggagagagagtatgcgggaaggggtagacgctcaccacgcggacgtgctgtgcagcacgacggcgagaagcgactgcgagggcgagtttgccgaaacctccgcttccgggtgcagggcgcgcgcgagctcgctggtagggcggtcggctaccgcaccacgctgccacgcatcgccgccggcgctggctgggcgagcaggggcaggggtagctcaaccgcgggaactcgccggggcagccatagagcagacgagatggtgcggtggaggtagttttctcgggcgcggcgactgctgcttgcgggcggttctgcgcgaagccaagagaatgggggccaaggagcatgcatcatggggaagcagggagagaagacaggaaagagagatggcaggtgggtcccacggcagcggcggcattgggaaaccgcccacgcgcacggcaggcacgacagaacggagccacggagcgcgaaaccgcgcggggcgtgcagcgcacgcgtgcatgggccgaccggggcacagcgacgcaaggcatggcggcggcggcagttggcgagcgcgcacacacgagcgaggcgagcgagcaggggcgcggcgcgctgggccgcggaatggcctacgcgcggggggaacgagagcggggctagggcgctgggctaggatgcgggggcgagggggtgggccaggtgggccgcgcatgccaggtgggccttggggaggtggttgggcgtggggagagcaagcccgcagcgggcgctgggccgcgcgcgaggcaggccgcgggaggtggcttttgtggaggacagatatcccccgggtccactagaaggctagaaggccacgcgaaggactctgggaccattacttcgcaaggctatcccttcgtgggccaggggaggaatcactagcagaatggatcgacacaagattggatcgactcgagcctagacagctcattaggtttaaacattatccacagcattgaaccgattcatccgcacagcaccctcagacgttggaactaaatgaggataagtcggcaggataatagggagataagttcagtcggttcactattacttaggagcacataattatcatacccgcatgtaacgccccacggtcgagtatataaggcctggggggcaccccatcaaaagacaagtcactcattagccatctactcaattctctagcattccttatactagagaactcccctgtaatccactacataaagagccacaccaggaagtagggtgttacgcctctctaagcggcctgaacctgtataaaattgtctatcgtctctcgtgcgcccagcacgaaccatcgagctacaatcgataacactatcctacccaaaagcacctcgaggggtaaccccgggtgcgtggtcaggtcccaaacaatgacagttggcgcgctaggtagggggtgtgtcgctgatccaagctagctcaatggccatcacttttcagcacaagatcgctctccgccctggatccatgttctgcttcggaaccatctcgtccgtggaagatgaagaagggattctacatcgtatagtggatccaccagagaaaaagccttccttgaaaatcttcgggaaagccggaacgaagcaggaaatagcgcaacctctagcgatccgggcaaagactacctcctgcgagccaggagcagagaatttgttcacccggagaaccccgttgtccacctcatccatggaaagatggacacggatcacaaggaaaaaagaaacaaaagagataaaggctcgtcaagctgcccttctggtacttccgccctcaaaagagaatagaaagaagcttgttgtaacggcaactccattctaccccgacgtcctcttcatcggggggagagtggaatcgtcccccatctccgacgacgaaccaaccgtgcctggggaagaacctcttcagcgggaagctcgtcgacgaaggaaccgacgccgtaatgcccggcgacattatgaagccggagaacgagacccagcgcagcctgtatcacgagatgagatctcggaggtgggataaactcccgatgaatgagtcttcagagaaaggaggaactcccgccgacgtgatcgtcggcaagctcaagagcaagccgagcaggaggcgagacagcgccgagagaaccctctcttcggacgaaacctgaaccccgacttcgctcgagccatgaacacaccgagcgagatcgatggagtgttggcccggatagccgatggcctcccccggactccagacaccgagggctatcggcggctgctcactcgagcggctaatcatcttctgcctctcgctcatcctccaagcgatctacgacacgccatcaacagtcggcaggacgcgcagagctccatcaatgcttcacgcgaacgatgacatgagaatgagatctggcgctgagaggagtatgatcgggatcacgacatccctgcacgaagtcaggccactaggattgagtcggtaacagcttcaactggcgacacgacccaaggacggtcgagacagcacatcggcaactcccctccctgggaccgacaccacaatcgtcgacaagaggacatgtgtggagtatctgcgctcactccacgtctcagggccattcagtggcccccaaatttcaaagtctccaatgtcgacaaatacgaacctaagcaagacctgggaggctggttggccgtttataccactgctgcccgggccgctggggcaactgaagatgtgatgactgcgtacttgcccatcatcctcgggcaagatgcgttgcaatggctacggcacctacctcgacactgcatcgacaattggagcgacttcagtcggtgttttatcgccaacttccaatctctctcttacaatctagcgcagccataggacctcaaatccattaggcgccaaggggatgagactcttcggtcgtacctcaaaagatttcagaccatgagaaatcgtattcccaaagttgtggaagcagcagtgatcaaggacttctatcgaggatctaatgactcggccttcgtccgagccatactacaaaaagcgccgaccacttccgaacagctgtttagggaagtggacctctacatcaccaccgatgaacgtgcccaggacctcatcggagggatgaagcccgctccgtctgcaccacggcgcgacgcgaaccagcaaaccgacaaacgctaggagaagaggcctcgtgaagaagtccatgctgctggaccacccgtctctcgtgcccgaggggcaccccacggaggcgaacgaacattggatgacatccttgacgctcagtgcccgtaccacaaggatatgtgtcatactcttcaaaactgcagagacttcaagcactccatcgggaatagccgacctttccaacctctaccacctcccccaccacaaggaggacccggagaacctcgccaacctcagcagcaggaagggggaggaggcggagcattcccgcgcgtcgatggagaagtcaacgtcatcttcggcggacatgggtcacaagagaacaaaaggcagcagaagctcaacgatcaccagatactggtggtggccaccagtgctcccgccgcgtatcgatggtccgaacacccaatcaccttcactcgggcggatcaatggctcaacttcgatcatccgggcaagtacccgctcctcgttgatctggtaatccgagagagcagggtaaaaaaggtgttggtggacaggggaagcagcatcaacgtcactttcccccgaacactcttaggcttgggagttgcactcaaagagctccacgagtcagacactcctttcttcggcattgtgtcgactgaaggagaatacccgctcggacacatctacatgccggtcaccttcggaactccagaaaactgtagaaccgagttcctaaggttcgaggtagcaagcttcgactgtggatacaatgccatcatcggtaggtcgggattagcgaaattcatggccattccgcactattcatacatgacattgaatatgttgggaccacaacgtcactttcaccatgcgtgctgatttccaaggcgccgcagaatgcttccgagtggccattcaggcggccctcaccaccaaaccaccatcgactttgtgaactcaaagcctgaggaagacctcgcgatacctgcaaatgaagctcaagtcgtgacctctatgcagccgactgaggaaataaagagaattaacctcgggttcgctgacgaacgcaagactgccatcatcagctccagcctagatgacaaataggaaggtgcgctcgtccagtttctgcaagataaccgagacatatttgcatggcagcctgcggatatgctgggagtcccgagagaactggccaagcacaaactgaaggtctatccccaggcgaggccgatccgacaaaagttgcatcgtttcacacctgacaagtgagaagctattcgtgtcgtgctagctcgcttagtcgcagtaggattcattagagaagtactgcatcctgagtggttagcaaatcctgttattgtactaaaaaagaataaagtggattggcgcatgtgtgtcgactatacggatctcaacaaacactatccgaaggatcccttcagacttcctagaatagatcaggtggtagattcgactgtcggatgctctatgttgtccttcctgaactgcttggcaaaagaagacgaggaaaaaactgcattcattaccccgtttggagctttctgctatacctccatgtcgtttggcctcaagaacgctggagcgacttaccagagagctattcaaacatgcttagtcgatcattggggcaagcgggtagaagcttatgttgatgatgtggtgattaagacagaaaactcagaaaacttcattgaggatctgtagctggtcttaaacagcctgtggcagtaccggtggaagctcaatccagaaaaatgtgtctttggagtgccagcagggaagctgctcggattcattgtcagccaccgaggaattgaagctaacccggagaaaattgaggctatcatgaggatggaagcaccacaatcacaaaagaaagtgcaaaggcttactggatgcatggcagctttaagcagattcatatcaaggttaggagaaaaaggcctaccattctacaaattgctcaagaaggtggacaagttccagtggaccacagaagcacaggaagctcttgatgcactaaagaagttcttgaccacgccaccagtgctaaagcagccacgccgagccatgccagatcatccggcagaagatctggtgttgtacatctcctgcacgactcacatggtgagcactgcgttagtagtcgagcgggcaggggaagggcacgcatatccagtacatcatcccgtctatttcatcagtgaagttctgggaccctctaaaaagaagtatcctcaagttcaaaaactattgtacacagtacttctaactgatcgtaagctccgtcactactttgacgaccacaaagtcatagtagtcaccgggtttccaataggggatattcttcacaacaaagaagccattggaagaatagccaagtgggcctgcaaattgggagctcacgacattgagtttcggcctcgcactgcaataaagactcaagcactagttgacttcgtattagaatggaccgagcaacaagtaccagacaacccggaggttgtagaagtatggcgaatgtatttcgatggctcgctgaaactacagggagcaggcgcagggatcctcttcattgctgtaggattacggggaggctacgctagcgcaaaacaaaattttcatccccataataccaagaactactgcggttataggtcatggaattaccactagacgcgcagagcagcggaagacgtctcgatgtagacgaacgcgtcgagcagtgccgtgcagtcgccggcgtccttcacgtcctcgcacggttcgtccaagtgctccagatgtagcacctccgaggtatccacacgtacagggaggaagcgccgcgtaccgaactgctaggttcgcgacggcggcttggcgagggcgagaggtgggcggcggctgttagtccgctggtggcgaattaggttatccttaaccgcgcccccgcccctcattatataggcgttatggtgggcttctgacgccgaggcccatcattaaccctaaagcccagtctaatttcggatctaatccgaattaggcttccttccccttaagtgtgtgaccctataggttcacgtacaaatagacataggccgagtactcttacttggcccaataattgacagcggcctctagcaagacatgtcaactcctatgtgtacgtaaagatcatatcagacgaaccattgcgacattacgtacatgctgttccctttgtctcacgatatttggtctggctctaagctgacctctctttctcgatactgtgaattggaatcctttcaatggttaactcttaaccctagcacggccatgcatttcttgatccaatcactcgaggggcccagagatatctctctcacaaagagagggacaaattccatcttgactgaccatgcctcatagcatgcttcctgacaaacccaaaactacctttataactacccagttacgggatagcgtttgatagtccctaagtaagtcaattcacatcttgagaacatgcgacaatctcaggtctaaggatacagtattcatgttgcaagaagagaactatattacaatatctcacgttgggtcggtccagcctcatgtcatacatgcgcccacattattagtttaacatctccatgttcatgacttgtgaaatgtagtcatcaactaatacatgtgctagtcatcgactctgactagggacatcatttagaataaccatataagtaaagaatctcacaaaacaattcacataattgctaatcaatacaaggtgccttccatggatattcaattaagcaatatatatatcatggatacaaagaaatatgctcatctctatgattatctctagggcatatttctaacaattgcccctagaggtgaacaactcaaatatgctcttcagttgttattctcagcatcaaataatgcagcagaatatgaagtctgatccacggattgaacattgccatatcactgggcattaagaggttgatggtatacggagattcactggtggtcataagtcagataaataaagactgggattgcttgaatgcttctatgggcaagtactgtacagccgtctaaaaactggaagacaaatttgaagggctggaatttcatcacgtggaaagagatcgcaatgcagcagcagacgcgttgtcgaaactaggatccagtcgagctcaggtcccacccggagttttcatacaggaggtgccacgcccaagcgttccctcagatcaggcagaagagtgcaatgatttgtgccggccagagtcagactctaatgactggagagggcctatcatcaggtatataaataatgaagaagaaccggatgataaggccgcaatagaacgccttgcaagacagtcagcccactacaccctcataggggacacgctgtacaaaaggggtgcaacaggagtcctcatgaagtgcattccctcggttactgggagacaactgctagatgagattcatgccggacaatgtagaatacacgcggcatccagaactctggttgggaaggtcttcaggtctggtttctactggccgacaacaaagagtgatgcagctgagttagtccagagatgtgaagcttgccaattcttgtcaaagcaacagcatttaccaacacagcaactgtagaccatacccgtaacatggccatttgcgtgttggggactggacatgattggacccttcaagaaagctcagggaggctacactcacgtgttgatcgccattgataaattcaccaaatggatagaatacaaactctatgcttctctaactttagccaaggcagtggaattcatacaagatataatattcaggtttgggataccgaatagcatcataaccgacctggggtccaattttactagctctgaattctttgatttctgcgaacaacggagcatccagatcaaatatgcatcggtagcacatccaagagcctggttaggtggaaagggctaatgaaatgatactggaagcactcaggaagaaagtgttcgacaagaatgaaaagttcgcaggaaagtggatcagagaattaccttatgtggtttggagcctaagaactcaacccagtcgagctctgcatggaaacacccccttcttcatggtctatggttcggaggcagtgctacctgccaacctcaggtttggggcaccaagactggtcttcgaaagtatagctgaagcagaagctaccaggctagaagatattgacgtactggaagaagagcgattgaatacaataattcagacagctagataccagcagaccctgaggcgctatcatgataagactataagacattgatccttcatagtgggagacttggtccttcgccgaattctaacgggagaaggacgacacaaattatcgccgctatggaagggcgattcatggtgtcggagatcactcggccaggatcatatcagcttactcaaatggatggcatggaagtggggaattcatggaatatagagcacctcaggaagttttacccttagcgagagctatcggagcaatgttgtactctgtaattggaaaatacgtcatcaataaaatatttcactctcgaaggcattcaaactattggttatcaattgacttcgacttgattagacttggaatcaacacacttactcaacttagggtgaccactataccctactaacgaagcaatcggcttaagtcggaaatgacttaaggcggtgcaacatgctcgcgcttactcgacttagggtgaccactataccctactaacagagcaatcggcttaagtcgacaatgacttaagacggtgcaacatgcccgcgcttactcaacttagggtgaccactataccctactaacggagcaatcggcttaagtcagcaatgacttaagacggtgcaacatgctcgcgcttactcgacttagggtgaccactataccctactaagggagcaatcgacttaagtcaacaatgacttaagacggtgcaacatgctcgtgcttactcgacttagggtaaccactataccctactaatggagcaatcggcttaagtcggcaatgacttaaggcggtgcaacatgctcgcacttactcaacttagggtgaccactataccctactaacgaagcaatcggcttaagtcagcaatgacttaagtcggtgcaacatgctcgcgcttactcgacttagggtgaccactataccctactaacaaagcaatcagcttaagtcagcaatggcttaagacggtgcaacatgctcacaactactcgtctttgggcgacctctatgccttaccagccgatcaattggcataaattaggaaaagactccaaaaccagcacgccgcacttacttccgcaatcgttcaggacgactgttgaattctaacaatagaaacaaaatgttataattttcagcaccaaggacacattctagtaccctatccaccgagtatccgagcacactgatcacgtacacacataattcacgaatgcattcagaatcttctaaacacgtcgctacaacaaaatatctctatttggcaatatcttctgcaggggcgatcgaggaagaagggtgactcgaggcatcaggcgtagcctggacgtcagcaacaatgtcatcaggaacaactacaccgggccttctcatcaggatccgccccgcgcgaatggctttgttcatggccttgtcacgctgagctttcagagtggcgcagttgtcctctgcaacattggtagccagtcgagcggcctctagctcctgggcgactaatttattggaggcacgcagatctttgacgatggagtccttgcttgacaccaactgcctaagctgcagaatctcatcctgggatacttgcagttctcgacgatgatgatccagatctatcattgtaaagcggtggctcctttccaagatggttaaggaattgctggcatcacgatacaacctatctagattgtcacgagaagctgcaagtgctcatttctcctcctacaaacaagaatcaactctcaagcatccagtaaacagtaaaagcacgatgaagccaattaagtaagtttaccttgttagccgcccttttagagtcaagctgagcattgagagaagaattcaaagaatgtgcatcgtccaaagaagaaaaaacccgagccaggtcgatctgacctcgggaatacttctcctcaagctcggagtaccgtcgggttgagtcggcttgatgttgaagatgtttctcctcaagcttagagtaccgtcgggccatatctgacaaagcagtcgaggaaggatacacagttaaaaacaagttgatcaatcgactaaggaagagacaaagctaccaaccagcattcgacgccttcaaatcagctatttgtttctgaagtagcaatggattccactgcgtcagagacatagccccttctggaatagtggcaccatgtgacctcaactgagcggacattccgtcaaccaaagcctgttattaaagacaaatgagtacagagaaaatgatttactaggaggaacgacagaacgaaaagagttaagttacctgaagattagaaaagaatgaaggcaatcccaagtcatgagaagctgtgttgtagctcgacgaaggaagatcaactggaacaatttgaagagcatcgtcgggggttgattcagccccactagcagatatcagaattctggcatccggctcgccgacctccaatgcgactcgcttgctcgaagttaaaaaagcatgcatcgctatcactccatcagatcgtggtggagacgacccgacgtggacgtccatggaggtgtgggaaggagagctcacttggacaccctcgggggctgggttgtagctcgctccacccacagagtcggatcaccaccggcaacaccctcgggggctaggttgcagctcgcaccacccaccagagacggatcaccaccggcaacaccctcgggggctgggttgcagctcgcgctacccaccagagccggatcactaccgacgacacccttagggctgggtaaccgccagcaccacccttgggggctgggttttctgcaacagccacctctaaggctgaaggatcctcagtcacctccatggaagtcgggcaatcctgaccaacttcttgacaccgaagactgccttccaaagtcgacgatgcgcgagatactgcccggaatacctctaatcccacatctggaattttagagcaaacatccatcatatcaccagcagtcggctccgacagcatatcttcaggaatgacatcctcaagggcctgatcaaaatctgttatggataattcttgaaggctaacaagagcaaacagagctggagaaggaatatcactatcccccctactacctctgtaacgccggctattattacgaattagcggaacttcttcttcctcttctttgtcctcataaaaaatacggacaatagctggtgcacggtcacacccattgggatcagtttctacacgattacacccattggggtcagcttcaacaaggtcacacccattgggttcagctggtacacggttacacccattggggtcagcttcaacaaggtcacacccaatggggtcagctggtgcgcggtcacacccattggggttagcttcaacaggtacaccaccattgggatcaaccttagtaaggacctctactggtacttcttcataaacaggagcagaagggccggcgtcttgatccaagcatgacagttgccgaagtcgcccctttttcttctttttctcctcaacaggcgtggttgggcggctaactgggcgaagacgcgttgggcgaataccctcaggctttcgggtgtccactgttttgttaagctcttgtacaaccgtaacagccattggttcaacacgagccgagtcagaagattctccaaccaacatattgagtacaacatctatttcttcatcatctggacttgccggcactgaaaagtgaacttgcctctcatcattgggaagatcacaaagagaagcaaccagagccccaatgtcttcaggagagggtcgcactctaagacccagaccactatcaccagcaggagggttggacatgaaattgaaaaaggacttaggaggtggtagattccaagcagagtaggcaactggagcaccaacatttgatactttgccccttaagatcatgtctagatggctcaccagatcctcagtaggaattttcttgttggtaacccgagtcaagtcagtaatgccactgtacaagtaagctaggtatgccctgtcctttaaaggttgaatgttcttaaaaataaagtcagcaaccactgcctcgatagtcagacctctctccttcagcagatctcagcaagcagaaccctagcctctgttaccaccaaggcagtgggagactcaacccaactcagagtgcgtacatctggttgtctctccgaccaaggggggagggacttgccgtggttttccacaataaaccactcaaggcgccaccctttaatgttgtccttgagcggaatgtcaaggtattttgttttcctcccgcggcgcatctccagacttgcaccacccacgagctggtgctgccccccagccatcccaggtcgacagtgatacaaatacttccattaatcgaaatgaggaagaattccgaggtaggcctcacacagatgtacaaagatagaaatttgcaagatggaatttggattcagatgggtcatgtttagattgtaaaagtcaaggagaccacggaagaagggagaaatgggaagagcaaggccgcggattagaaaaggaacatagacaacggactcgtgggtatcttctgtcggaacagtgaccccatggcaaatccgccaagaacaaagctcctttggaggaagaactccaacatcgacaaggtggaggagatctgattctgagacaatagacatatagttacctgcccccgacaactggttgttgggattgatgggaggaatgactaccgcagcagaattctggttcttccacttgggcgccatcgcaatctcgccggtggattgaatagaagcgaaatcagagggaaacagaggagtggcttgaggcggaaatgtgaagttagggctcaaaactcagaggcgtgtggcgacgtgatataaatggggttttctcgggttgggcaccatttctaaaaagtgccaagtcatcactcgggaaaacaagatttccgacataactcgctgttacctctgaaacgctgacaacatcaagcaccactcggcggttacctctaaaaaaaccgacagtgtttgtcataactcgactgttatctccaaaacaccgatgtcgtcaagcaccacttggctgttacctctaaagcatcgccaatgtctgtcctaactcggcagttacttctaaaacacagacgtggcccagcgtaactcagctgttacctctaaaacaccgacgtggcccagcgtaactcggctgttacctctaaaacaccgacgtggtccagcgcaactcggttgttacctctgagacaccaacgtcatcaagcaccactcggcagttacttctaaaaggcgccgatagtgtctgtcataattcggccattttctctaagtaaatgccggcagaaccaaatacgactcagtaattaccagtcattactcgggcgttatctctaagaacaccagcagcactaggcatgaagacaaaccatcgattgactataaaagaagaacgatggaaaagcgaaaggacgctcagaacaaagctgaaactttcttcgatatataaaggagggaagttcttccacaaacttaaagaccaactcattatgagtcggccttccttccctttttcgctacattacattactacatcactacactactcacactacactatactactaactactactacattattccactactactaatactatttctactacttgttatctatactaatatttaaaccagtggtgctttgccactggccttgttgctgccgctgtcgcccttgccgctaccgccgttgcccttgctgccatcgccgtcgccatcaccgccgtcgttgcctccatcgccatcatcgtactcgtcatcgccgtcaccgccgctctcctcctcggacgagtcggaggagttcccctcgtccgaggagatctccaactcatctgagccctcgagcctggggcgctcgatgacccggatgtacgtccacacctcggcagcgatcccctaggaatcgttcgagtcatcggacgacactgggggagaggcgtagaccggcgacccctcggactcagaggaaaactcctcctctaagtactcggagtcaccaaagtcctccaagggggacttggctcgcgtttccgcttgtcgtcggagtggtgcgacaaactttagcccttcttgttcttgcccatgcttgattggaagagaagagaaaagtgggagaataagcaacaaatggccagaagatgtgtgaagacaacagcgaagcaggcagtctatttatagaggtgagaagcaaccgctcatctcctaccacggtcactgaacagtcgcaagtatttaataagcaattcaaatcgtctagaaacaagtcaggcgacagacgtcatttcacgtaacacgacaccattgggactgaggtcaactacttggacgatatgattacaccccgcggtcacatgaagttactactcaagggcagtttgctaaacgctcagcgcaccaagccgtcccttggttacacccattggggaggggacgtccaggaattttcaatagattttcccaagcagtcacatccatacagtatacgcaatgaatgtatcaagacagaagaaagatatcgatagagatcagaggaaagccaaaaatagctactgaagtacaagtctaatcaacaaaagcattgaagcacgaagtgaaatgaagaccagccaagagccatctaccagacgtccaatctgtcgccgatcaaataaatttgaaacctaacaggacatgggtagatcgcgttgccgatttctaaagcaggaattgaagacaacaggctgatctctaaaagcataagctgatgatataatgtcgaattctaaggcatgagatgaagataaattaaagatttctataaggcatgagatgaagacctttgagtggattattttcagtaatccactcaaagctgggggctacacccattgggtgcacctccggtgcacccaatgaattatcaaccccgaaggcagaacgctgatctctaaggcgtggaacgacgatgaaatgctgatctctaaggcatgagacgaagatgaaccagcaacttctaaaaagcatgagctgaagacctttgagtggattatcttcagtaatccactcaaagctcgagggctacacccattgggtgcacctcctgtgcacccaatgaatccttaacccctaaggacaaaatgctgatctctaaagcataagctggtaactgagcactattttctgaaatacaaagtaaagactgttgaaagagccgaagaagataacagaagcttgtttttactggattgatcaaagttcaggagcaacgagctggacctaaaatctttgggccgattgtttcaaaatcaactcaaagattgggggcttgtgggggacagatatccctcgggtccactagaaggctagaaggcctcgcgaaagactctgggcccattacttcgcaaggccatcccttcgtgggccaggggaggaatcactggcagaatggatcgacacaagattggatcgacttgagcccagacagctcattgggtttaaacattatccgcagcattgattcaattctcccgcacaacacccttagacgtcagaactaaccgacgataagtcggcaggataatagggagataagttcagtcggttcattattacttaggagcacatagttatcgtacctacatgtaacaccccacggtcgagtatgtaaggcctagagggtaccccatcaaaagacaggtcactcattagccatctactcaattctctagcattcctcatactagagaactcccctgtaatccaccacataaagagccacaccaggaagtagggtgttatgcctctctaagcggcccgaacctgtataaaattgtctatcgtctctcgtgcgcccagcacgaaccatcgagatacagtcggtaacaccatcctacccaaaagcacctcgaggggtaaccctgggtgcgcggtcgggtcccaaacatcgacaactttcccctttttcttccttttctttttttctattttctgctatcaattttatttactataacgagctacatattaaacggatacacaccaaagcaaaacatcacacaaaaacaaatgtttttccagcatgatgcatcaatcattattcccttaggggttttacttgactaggctttcacatagatataaaacaaaataattcctcactctttaggcaaaagaaaagaaaagcctggaaaagagagggtaacatctgaatttggtggactattagaaaagaaattttatacccccaaattccgggtgttacaaaaaccacgcgcaagtccactggactgattggcgtgcctcggcatcagctggctccaagacatgaggagagcagcagcggcagtaatgccccctgttggggacttgtccttaaatgctatgaattaagaacaaggcaacacagaaattgtcaaacgttaaagtccttcgtccttcgaagcattatttccttcgggatataatgagtttcgcacgaaggttatgaaggacataccttcatcagtacaacaaataatgaagaaagattcatataaggtatgagaaataacataaacgcttaaatattattgttagctcatttctattttattattatggaaaaatagaaatgataacaaattacaagtgtaccttcggcttgaaagaagataaaggtacaagcgtgacgcaaaagcaaatgtcaagtcagcgtgaacagtacgggagcactgttcatctatttataggcacgggacgcagcccatgtaaaattacactcatgccctttacatttgctaacaactctatagtaatccatcggggtctaaatagccttttcccctttaagtcggtttccttttcagctatcacgccgaagctcccctgcgcatagcttcggctctgcgccatccttcatattctttgtgcttcttcacactgtggttttgacctaagtccgaaggtacctattcatgtatcatactctagaaacattgttaaatcatgtttttgaggaccttcggaagccgaaggcccccaacagtagcccctcgcaatattaatttgttagaatgataaattcagattgcgatatggacgaaggccttaagccgaaggtccgaaaaaaaacaccttccctttgctagaatagcaacagtcaatgacaagcggggccctcccacttgcaacgcactaggcgtataaataagagcacaccgcgagctcatttggcacgctttcttgccatctgctcgtgctttcccaatttttagctcttgcataccaacgcttgcttggttttttaaattttctaagcttcggctttgagaacacctgtttccaacatttccgaagatgtctgaagataaaaaagctgttgccgaaacaaggctgagtctttctgaggagaagaatcttgggtttcttgaatcaatagcaaagacaaatacagaaaagatcactaaggagattttagaaggtttatctgaagacactggtgatagtgatagttatgatgtgaaaaatgggggcgaggactctgaagatcgaccgtggcgaccaagtcacgcagtcttcggaaaatcaactattaagcagagtcatcttgacaatatgaggggaagatattttcgagatatgtctctggtgagggctgacaatggagacaagactgctcctactcccgaagagaatgaagtggtgatcttccaaagctttttcaaggctgggcttcggttccccctaagcagttttgtggttgaagttttgaagatattccagatttttcttcaccaaattactcccgaagctatcataagaatgggaatcttcgtatgggatttgaggagtcagggcttggagccaaatgcaaaaagtttctgcagtatgcacgaactgttatatgagatgaaaccctggggcaaagagcaataccataacaattttggctgctatagcttcgttgctcgctctgggtcaagctgccccgtgccgacttttcggaagagatggcccggagattggatgaaggaatggttctatgtgaaaaatgatttaaaagcacgagaggatattaaggaaatcatcatgcgccctatctggcagcgtttcggcctccggaaaccgaaggtggaaattgatgaagcagtcgaagaatgccgaaaggcctttcgcatagtttgctctttcatcgggacaagggatttagtgcaggaacacatagccttcagagtgtggccacttgtagagaaatgagaaatgccaaaggagactatcaacaaatctgacgaaggtgggctggtcaggttgaaatacaccttcagatatgaaggtaagtttgttgagccagatgatgattgcctgaaatgtatcgaaggtacaagcaatgaactgcttgggccatattcaaaggcagaagataacacattatctgcggccttcggaggctggaagaagaagaggctgaatagagtcttcgacgctattgggtttatgtaccctgattaccgctacccgtcgtgggggcagaagaggaagagtgccacttccgggaaggatgctgctccagccgctccaagcgagcctgcgccgaagaggaaaaaggtgaaggtccttactcaccggccgcgatatatcgaaccggccgaagtgcccgaatttggcggtgagacctcttcgactactgaagccaaagaacttgcgtttacacagaagattgaagaaccgactgtaaagctgaaggttaacaaaattgaagagcctggagtcgaagacaaatatcagttctacacccttcggcagaagtaacagtgccaaaggcacaaaaagatcttatagtgaccccaaaaaggaaaaggatggtcaatgtattagatgtactggagacgataaagagttcaagctctactccaggaaaaactgccgaagctccaaaaacgtaggctgagacaaaactgactgaagccgaagctgcaaagagccaggacgagactgaatctgggccttcaaagcctgccaaggagaaatccttggaaaccggggaagaagaaacgaaaaaagaggctacaaaacaaattctgcctgaaagaactgtcacttcaactcccgaagcttcttccaaagtacctgattatattttacgacatgcttcgggaaaaaggttatctgaggaggaaaagcgagaagctcaatattatgcctagaaattaaaatatccaaagggggcattaatatttaacgggagcgaagaagaagacttcttgtattgtctcccagacagcaaggaaatttctgtctgccgggagatgggcaaaagctttggattcctgactctagaagatgggctttcggtgctatcgaaagatgaaatggcggacaacttagcatataatagcttaaaggtatgagaatgaattttttgtattaaaaaaccaatatttgttttatttgcttacacctaataccacacttctttcgcagggcctcattcttagcaacgcccttagggcgcaaaaaagtgccgaagatgaaggatgcactatagctttgaacaaccttcgttccgaagtaattgaactaaggaacaaaggtcttgaaaaagataagattttaaagtcattgttgaacaaaatacaagaagacgagggtacttccaaagcccaggttgaagcccagagatgcgaaattgaggatcttcggaaacagctggctgaggcgaaattaaaatgtgctattgccgaagctgaccgagacgccagtgactactggaaaaattactgggaaaaaatagttgtagagcttcgttcttcaaaagaaagatgctatgaaaaatctatagcatgtgtacaaaagataaaaaccagcttcgccaatattggcgcatactcgaatgaagacaacttcgtactgggcgatcccgaaggtccaatcgaatggatcaatggcaaagccgaagcctttgaggaagttttgaatggtcgtggagatgtctgcgccttctcatgtgccaggggaattgcggctatcttggagaaggcaagatgcgaacacgtgaagattctagcccaagccaaagttgctttctctattgatgatacgaaggatccctcggccgaagcaagcttagttggcggaaaattctttactgacatttgggaaaatggcggccgagggatagcccatgagataataaaaaagagcgaaaaagatactcacgatacaagagaagcagcgaaggcagctgagaaagctgcggaactcaaaagacggataggtattggctaattgtttttaactttatgttttatttttgtgacttcaaacttatttacgttttgcatcgcagctgaactgtctcctcctccagagccctttgagtcaatgtccgacccagaagcagagaaagaagatgaaattactaaagtggccaaagctattatggacgaaagctgtttctcgactgctaacgaagctgcggaaacagttttaaaagaagaatagttgttattgtaaaaacatttggaatgtaatattttctgaacaaagtgtgtaacattttataattttgaatgtaatatataagttgttgtaattcaattctttacgatgcatgaaactttacgtgcataccgtttttgagccttcggcgaaaaaacaccttcccttcttttcatgcttcgtgaagaatatccatattccgtaaaaacatccaatctccgtaaaaacattatactttgtaagcaatagatctcgtttcatattagagttgatgaagttgtacttcttcaaaacttattttgtgccttggcacaacttcttcaaagcaatttccgaagattaacattgtatccccttcttgtgccattgatgcaatatgatgaatgatgttatgttatgtgaatgatgtgatgatgttatgctatgcagaatgatatttgtgccgaagatacacacacattcccacagtagaacacacaatctctttgtcgtttatttttcggcttcaccgcttatttttcagtgtatcagcgctgacttttcgctgtaagcctcccttaggagcttcttcgccttctatttcggcggtattcgcgttgacttttcgcacttcgcctaatacttcggcggaatcagcgttaatttttcgctgtaagctctgcattccctttggaacgacttttgagcagaaaacttacgttgcgctcccttaggaacgactttttgttgtttcaaacttacacagcgttccttagaacgactttttgttgcttcggcaaaacttacactgcattccttagaacgactttttgttgcttcggcaaaacttgtaatataattgtgaaccccgtgttctcttgagaacaattttcgtgttgtactgacttttggaacttcgtgagtctgtgaagaaggtatattatatcatgacaatgacgaagctattacaagaaattgaaaacaacaaaagaactaggttttcaatgattgctccttattgaaaaggaaaatgatgacgaatgcaaaaactgtttcagaggtaggatatctcttagtagatgtgcttcgattctggcacaatactgttgactgtgtgagcttcggactgctccctgaagtctcgctgttggtgagtgtgctggctcccttctggctgctggccttggggatatgcgggttgcattggtggtggaggtggaggctgttgccaagatgcctgaggttggcttgccgaagcaacaaaagctgcaggatggttacccacatactctggtatgtacggtgaatgatatgaagcagtatgcataacttgcttcggctggttctgttgggctacagcttctgctatctccttctgtttctggatggtgacatggcacatccttgtagtatggcccttgtcctcaccacagaataggcaataaattttcctgggttgatccccaaaccttccaccgaagcccctggcgcctctgccccttggagctggaggtcgaggatagctttgttgctgccctgaagcctaggaggaatattgcggcctctgctgctgacctcctctgtcgtcattctgagtagagtggattgatctgacgtgccttgggtggactctccctccgaagcccctggtcattttggagaacatgtaagctttctcccttctttgccgaaagtcattatcagcgtggatatattcatccatcttctgaagcaatttctccagggtctgagggggcttcctggcgaagtattgggccgtaggtcatagccgaagccccttgatcatggcctcaatgacaatttcattgggcactgttggcgcttgtgcctcagacgcaagaacctttggacatacgcctgaaggtattcttcgtgatcttgcgtgcactagaacaaagcttgagtagtaaccgacttcgtttgaaacccttagaaactggtgatcagcatgtccttcagcttctgccatgatgtgattgttcctggccgaagagaggagtaccaggtttgtgcaacattcttgactgccatgacgaaagatttcgccatgactgcagtattgcccccatatgaagatatggtagcttcgtagctcattagaaactgcttcggatctgagtgtccgtcatacatagggagctggggtggcttgtaagacgggggccagggtgtagcctgcagttctgctgacagaggagaagcatcatcaaaagcaaaatttccatgatggcaatcttcataccattcatcctcgttttagaagccctcttggtgcagttctctatgctggggtcttcggtgttgctcatcttgagtaagatgacgtacttcttcagtggcttcgtcaatctgcctttgtaggtcagctagccgagccattttttccttcttcttttgcacttgctgatgaagcatctccatattcctaatctcttggtccaactcatcctcttggggtgttggactggtggccttcctcttttggcttcgggcctctcgaagagaaagggcctcttggttcggatccagcggctgcagaacggcagcccctgtcgctgaagctttctttggcggcatgacgaaggtcgatgcttgccttcgtcatgcttgccgaaggtggtcgaaaagggttcaccggaggtgggcgccaatgttggggacttgtccttaaatgctatgaattaagaacaaggcaacacagaaattgtcaaacgttaaagtccttcgtccttcgaagcattatttccctcgggatataatgagtttcggatgaaggttatgaaggacataccttcatcagtacaacaaataatgaagaaagattcatataaggtatgagaaataacataaacgcttaaatattattgttagctcatttctattttattattatggaaaaatagaaatgataacaaattacaagtgtaccttcggcttgaaagaagataaaggtacaagcgtgacgcaaaagcaaatgccaagtcagcgtgaacagtacgagagcactgttcatctatttataggcacaggacgcagcccatgtaaaattacactcatgccctttacatttgctaacaactctatagtaatccatcggggtctaaataaccttttcccctttaagtcggtttccttttctgctatcacgccgaagctcccctgcgcatagcttcggctttgcgccatccttcgtattctttctgcttcttcacactgtggttttgacctaagtccgaaggtacctgttcatgtatcatactccagaaacattgttaaatcatgtttttgaggaccttcggaagccgaaggcccccaacacccccattgaagatctagaagcctaagtggaacaacttcgaatggagctacatcacagaaatagggtgtgggttgaggatggtcagcgtataaatgagttaagaactgacatccgacatctacaagacaagcttgccgaacgggatttggcaatcgattgggctgtcaactcacgttccattgcttgggaccgggaagccaaacctcgagcccatgtggaggagcttagcacggccgtcgataacttgcaagtgtactgcaatacattacatgaggaagttcatgaattgtattcatgactgcacccagacgtacctgccgaccctgttggaatgggagccggaccttctggaacagcaggtgaagcactgggtggggaattggaccttttgaagccccctccttcaatgaacctggctgacgaacggtcccctacaaccggcagtgaagctactaaggacaataaatactagcagtagtatagttcagatatagtactaatgtataataggaaatgaagtcatgttgtacattgagtctgtaacattccatcttaagtaatgtaaaatgatggtgtgtatcgacatgttatatttttccaaatatttctttgcttcagatgccatcccgaactcgtgcacatgacggcgcgggaacatcccgtggtcaagaagatacacccaatccatcgctggtaccgcccacgttggtcgaggctatcgctgccttggtcaccacgaccgctgacaacacccgcttcctacgtgaaatggcaggacatcaacttcagcaacaagacaggagggcttatctgcagggaccccgtgaaacttcgtacctggatttctcaaaaacccgtcccccacttttcgtcaaagctgaggatcccctcgaagctgacgaatgggtgcaggtcattgagcagaaattttgactcatccgatgcacagagacccagaagccattgtttgcggctcagcagtgaagaggcccttccagcacctggtggggaaattatgtggccattcagcctaccggacatcaagtcacatgggacgaatttaaattggcgtttcgtgagcactacatcccagaaggagtgatgcatatgaagcaggaagaattcatgaggctcaagcaaggaggagatactgttatgcagtatctcaacgaattcaatcatttgtcctagtacacaattgaccaggtcaatactgacctgaaaaagaggaattgttttatgaggggcctcaatgaccggctacaaagaaagatggccacctgcctcgatctctcctacagcagggctatcagcacagtgctggcagttgaagctaagcaagcaggcctaggcaaatcaaagggaattggaggtgaccggtccaacaaggggcctgaaaagcgacaaaggttggtaatccgacctttcaatcaaaatcgttcttcgcctcgtccaccctcctaccccttcaaacatcgtgtattcatccgccctgccactgcccccactttaataactcagccgagtacccctagtgctcgtttcctcgtcctcccgagttcttcaattggctgcttcaattgtgcgaagtctggacattttatcaaagattgcccatatccgaagcagaacaaatccaataatcagcaaaacccagggagtttaagccaaggcaagggaaacacgacaaataattcagcaggaaaaaatataaagaagactgggctaatctactatacacaagtggccactacactggagggagagccggttatgatgggtacgtttttcgtggccaatcaccatgcagtcattctcattgattctggtgctttgcatacattcataagcaagaagtttgtggagaaatattgcattccttgcattgaatcaagggaagggtttattattcattcgcctaagggacaaatattcactaaagaagtggctttccatgtgcctgtaacattggttgaacgggactttcccacaaatttgattgttctgaaaggccaagatatagatgtaattctgggtatgaattggttagcccagcataaagctatcctcaacactgatttgagaaccatcaggttgagctatggctaggaagaggttctcttgtccattcctgtagctattcccgctaaaccatttggcagagtctacgaagccatcataccagaaatccaagatattctggtagtatgtgaattcctggacgtctttccggaagatctgcctggattgcctccagagagagatgtagagtttgtgattgaattgaagcctggtacggctcctgtttctagaaggtcgtaccgaatgcctccaaatgagttggcagagctcaagacacaattacaagatctactggagaagggattcatccgacctagctcgtcactctggggttgtccagcaatctttgtcaagaagaaggatcaaacgctttggatgtgcgtggattacagaccccttaatgaggtcacaatcaagaacaagtaccctcttccctggattgatatcttatttgatcagcttaccggagcctgggtattttccaaaattgacctcaggtcaggttatcatcagatccatatccgacccaaagatatacccaagaccgcattcactacgtggtatggattattcgaatatctggttatgtcttttggattaacaaatgctcctgcccacttcacatatctgatgaactcggtattcatgcccgagttggacaaatttgtagtggtcttcattaatgatatcttgatttattccaagaatgaagaggagcatgctcggcatctacggatcgtattaacgcgcttaagggaccatcaactatatgctaaattcagcaagtgcgcgttttggctggaggaaatccaatttctaggacatgtattgtctgccaagggggttgcggttgatcccaccaaggtcaaggatattttagagtagaaaccaccaaccactgtacatcaagtccgaagtttccttggactggctggttattaccgccgatttatcccagatttttccaagcttgtgaagccaatcacaagtttattgaagaatgatacaaaatttaactggtcctcatgatgcaatgaagccttcaagcagctgaaggtgttattgaccactgctccggtattagctcaaccagatattgaaaagccttttgatgtgtattgtgatgcatcaggcagtggtttaggttgtgtcttgatgcaagagggccgagttataacgtatgcctcaagacagttgcgccgacatgaggaacattatccaactcatgacctagaattagctgcggtggttcatgccctgaaaatatggcgtcattatctgctggggaatatctatcatatatatacagataataaaagcttgaagtacatttttacccagtcagaactaaatatgaggcagaggagatggcttgagatgattaaggactatgaattggaaattcactatcacccaggcaaggccatggtggcagatgcactaagtcacaaggcttcctgccattgtcttacaatgaagacttttgacatcacattgtgccaagaaatggagaaattgaacctagaaatgattcaacatgaaaccttaaatcacttgaagcttgagtcaattcttctgcaaaagattattgatgcgcaaagaagtgatgagggtatgaaacacattcatgagaaaataaaagccggtaaagctaactgtttcagaaaggatgatcaaggaattgtatggtttaacaaccgcatagttgtgcccaagaatgacgaagtccgccagcaaattttagatgaagctcatcttagtcgctattccattcatcccggaagcactaagatgtatcatgatctaaagcaacattattggtagacaaaaatgaagatcaaaattgcacgttatgtggcaagatgcgacacttgtagacgtgtcaaagccatacagatgaaaactccgggtccattgcaatccttacctataccaacttggaaatgggaagacataagcatggactttattgtgggattacccaggacaacaaaaggatttgactctatttgggttataattgattggcttacgaaaatagctcattttctgccaatcaagacatactacccgatcatcacttatgcccagatgtatattgctcgtattctcagtctgcacgagattccaaaaactatagtgtcggaccgcggaccacaatttgtatccaattctgggaagaactccacaaatctttgggtactaagttgcttcacagttcggcctatcatccccaaaccagtgggcagactgagagggtgaactagatacttgaagacatgttacgagcatgtgttctggaattcccacagaaatgggatgattgtttaccattggcggatttttcatacaacgatggctatcaagagagcatcaagatggcaccttttgaagctttgtatggacgacggtgtcgtactccattaaactagtctgaaccaggagatagatggtttttcaggcctgatatggtgaaagaaatggaagagaaggttcaacgaattgtacaaatttgaaggaagcccaagctcgcgaaaagagttaagcagacaaacgacgccaacccttgtactttcaagttgaagattatgtctacctgaaagtctcaccaatgaagggtgtatctcgttttggggtataagggaagcttgcaccctggtacattggtccttttcctatccttgaaagatgtggaccagtagcataccgactccaattacccgaaacattatctgcagtgcacaatgtgttcgacgtatcctagttgaagaagtgtcttcgggttctagatcgaaacgttgaagtgatggatgttgtcttagaaccagacttgacatattcagaacatcctattcgagtcctggatcaaaaggacaggattacccgaagaagaactctcaagttttataagatacaatggaaccaacacacagaagatgaagctacatgggaaactcaagactttctagaaaataatttcccaggctttttagcttcatgtaaattgtgagatatgtacaattgttttaatagaggagtagaccccataccacccccttccttgtacaagaaataaggaaataaaaatatgacgcgtttccttttccattacttgtcctaggactttttaatctcgggacgagattctttaatgggggaaaggatgtaacacccctggtgttactgtcactaaaacttgagcataacatcatgagcattagcatatcatgtgtttgttacacttagggtgcattcactaggcaaaaatttcaaacaagttgtattgctgtgactggtcatgggtgaaaccctagggtagggtacttaaccctaaactaggcttaggagtgtcaatacatcctaaatgagataaaagttcaaaacttatgagaaatagtcataatatatcacctttaatgaaccttgatagcaccaaaaccctagaagtgccaaaaacactaaaaagaccactaaaaaccccaaattgaaaccctagggggttatttgtaaattttgaccacttttggatctcagtgcaaaaaccaaggtattagggtaccctaaagcataaggttcacacatttgaggatttccaagtcaaaagatgagatttggggcttatttgcaaaaaagccactctacacctctcatgtgactaagtctgaaaatcagtgaacagggcttactttggagctctgtagttttaaaaatacaaagaatttgcctagggtcaacacatcaaaagtctagagctataataggagcacaactttgcttaagtgattaagcattgttgacatacaaaaattggagataatcagccctgaagtctggctgtcagactaagactccattatattcagagaaggcagtagattggatcaactttgggaccttgtggagctcgatttgatggatgtttaaccaaaacctctgtgacaaatttaaagctggtttgttaggctacaactttgatacagaatgttgatctggccaccacataaaatttggagcaatttgcccccaaacaggctcagtcagactgactgaatgaggagcgcgatggtacagtgtccggatcagaacgccagaaccagatgcctcaccgccggcgatcgtgagcccggatttgcgccacggtgattcatgcctagcgcagatggataacgaagaagggtaagaaatatcaccccatggatgaactccggccactattctactccggctcccgtacccgcttgagtcacggccgctttggataggctcgccggagttagccacctcgcgaccctgcgccatgtgccttggtgctttaaccatgtcacagtgagtcatcttagcccacccgatcatcgccggtgagcccgccacgataaatgccaccaatcacttgcgccagagcacccccttctctccggccaccgcacgtcttttcccgaattagtcgccaccgctcatggatcctataaattgagcctcccgtcagttccgcaaggtagtccagcatccaatccacccgcttgtgcctccaattactcaccagagagccccaatttgggatcccccaaattggtctgaaacaccgcgcatagtgacctcgtcgtggctagctcgttccaggtccgttcatgctgtttgctctcctgtttcagtacccatatgtcctcctgatgctcctcgacccattcaattaagccagaccacgctagatctctgggaacacttctgttcatccgtagttcgcgctgtctctgtggacagggtgatttagagccaaattccagtaattaagtgaggggaaatggtcgtgtagggttgaattcggtatccagcaaaggggagagctagccgttgagttatccggctggtgcaggttcaccggagctcgggctagaacggttcgccgtcgaggaccgtaggttgtaaagaattagaaagggagggaccttgatgcaaatgtcagtgagacaaaacaatagtgtcgcggactctttcgggttgtttaaaaagctagggtcttctgtgcaaagtcggcaccgcgggtgcgggcatgcctgttttcgcctgggcatgggttgacttcggccagttccggcccaatactattcatgtttttcctttttctttttctgccaggattagataattcctagaaaattgtagaaaatgctaaaaatgcaaaaccaattttgctaggctcctaaaattccatactatttaataaaaatagttttatgatttttagtccaaataaggaattataaagtatttaaaatagccaaaacttgtactcctggaattttagaaattatttagtaactccaaaaatcactaaactttttggataagctttaaatgttattagaagccttgggtaaagttgggcatgatttggacaatgtttggtgcctaaaccccaaaaccctaatcttctagttatgcttgccctaggaactacagttctgactccaaaaaccctagtttcgtggagtaccgtgaaggaaaattgtattcaagacctaagataatctacttttatttttgtgcatttttcgtaagcattacatgagcattcatggttatatatgtgatatagaaaacaagaagaagtagaagttgaagaagaaagagctacaccaccaccacctgaagacccacctgccgggaactgcttttatttttgatatttgtggagcagagcccgactctcctataacacaaggcaagccccggtacatttgccacacctccttgctattttaaaatctttgtcacttgcctgatgcattaggtgataggagttgtgtgcttaaaccattgatgcatttccttccttggaaatttaattgcccttccttgatcccctattttataaaaagatttttcttgtgcttagtcttgctctagaaaaacaaaatgttttgttttgacaaaagatgatgcttcaagtaggaaaggatgttttcaaaaataaaactggatggtggatgcatcatggccgtgatgggttcaacatcagaaaagatgtacctctatcaggtaccaaactttgggttaaaatgataaagttgagaccaggcaggtgacttgcacgagaagagagtctcggtgtagtgtctccgtctgagtcgattaaggaccgtctcgatgtaggcttgatgatcgaggaccttttaactggtcacatgcctcatcatgggtaagcttggcctcgggcagactaatactagaataagataacacgtaatgggagtggagagatggcgagagtagcgtgtaccctccgtggcaagaggctggacggtggtgtatctgtgctctcggttggcgtgaacctgatttggtcttaagaaccctggtggcgagttgacatatgcaagggttaagtgctacatatgtcgtgtgattggagatctccagctgggtataaatctattcgaatcgccgttacttctcggacatgaagacttggtcactgccctacacgtagcattccaatgaacaagaagggttgattagaaaatggctagtataggccaagtgcttgaattagggtagaaagaactctagaattcaggtaatgacttaacttgctaataaaacctagatttttaaggatccactattagtaagcatttttgcaaacagagtcttgattatatgattaagtcttaccttgactcccccaagccagcatatccttgagagtcttttattttgacgggtaagacttgcgaaagtacactttcatacttagggttttcgaacccattttgttgtaggtgaggaagcagcaaatttttgttgcttttgttccaaggtggtgcccaaggaagaaaaccaggattaaagcctcgggaggaagtgtcctcctttaaaaactttttactgttaaacgagaggggttttagcctcccgagtttgtaataatactactccagtactcttataatttactagtctgtaataataatactctttctatactttaatataaaataagttgttgtaactgcttcggcatattcgttccttcgatgtgttgcgcgacggctgaaacgatcttgggcaaggtaaagagtttagataccaaacttgtcaagtgatcaggtgcacttgcagggttgctcgaggtccgatggacaaggacaactgtaggtgggtataatgacttaagaggttctgtcacaaaaagtaagtaggatatctttcaaaaaaattaaagagcccactcctacaaaaagtaattcaaacggaataatcaatgaatcatcctactaaggggaaaaccgatgaacagggacatcacttcatccgcttgccattgtatcaactcaattggagatattgaggcacacagaacatgaacgcacatagatgctaagctcctggtagcggtggcatggaatgttgtgcgcattgaatctgaatccactctacagaacacaatcacgcctaatccaaatcagtgatgaaacaaatcatgtgaccagcgttgaggggatgaaggcacaattgcctcgctcagctgtgccaatcaagtcgacaaactcctcgatccaacaacccagcgtcgtggacgcaaaggcctcgccgccgccatggggtctgcgaaacaggagtgaagatagagtttggagaaggaaaaggaaggcagcggggtggagggtccatgcggtggttcggagggcggcgtagattatggccggccggggcaacgatggaggagtaagagcaagagatgggtgatgggttcaacgatggatgaagcacgagacgacgctgactgacctggcgacggtgtggggagatagagggagaggatggggtgggggaagtgcgtggaggacgagggcgtcaggcagtgatgacaaagacacattgcgggggattttcagaagaacagccacaaagacacattgagtggattgatgatattgcatagagaacgagtacaatatatagactcaaccctaatcctaatgggccggcagcccaacagtggtgccggcccacacacactcacacacacagtctaacatcctctcgcagtcgtaatgggggcaccacacacgatgagactggagtagaggtcgaaggtaggagccgacgggctgaaatccccccgcggtcgcagtgtcatgatggtgcaaatgttgtggctggaatagagaccggtgtgcgctccaagaagacgatagccccttgacgccgaggtagccaaattcgaggtggtcgcggtcgggagacacacagcagaagcctgttcttcgggaggggtcgacgttcgagcgtcaacgatcggcagggcgacacaacaaaagagcaccagcagaccgaccttcctgcttctcgatcgaccagccgtcaaggagccccgccaggtaggccgacagcagcgcacgcgtctgcgccggtcatggtgtccgtgcccgcggcacaatagaagggggagacggctgatccagccaggaagaccacatcagcgacagatccagccgggaagacacgatccagccaaagggacggcggatcacgccgaaaaggtcgtagcaacgtggatcctgctgggaaggccgcgatagcgacggatccagcgaaggcgaagaagggggtgggcggcggggcgggtcaagccgggcaggggcctacgccagacctggcaaggggtgttgacggcagtagtgatgggagaagctcgaagtgggaggcactgctggggtgtcagcgcaagcaattaggaagaggctagcgcgatgacaaggggctgcacgggcgaagatgccgacacaggcgagaggagcgcagggtatccataccggggaagaggtggccgacactggtgaggatggtagcgcgcgcagggggcgctgcgcatgggagcggcggcgtgcagggaaggccgcagggcgctgtgcgtgggggtggctggagcgtcttgagcgggagcaggcacggcgcgaggaggaagatgaccgagatggagatgagcaggagcagggagagtaggaacgacgactggagagagagagaggggaggaggcggcgactgctgggagaaggacgccggcggctggtcagtggagtagacgagggcgggcaggggcctggcagccatggcgcgcgccgaggaggcgacccgcgggaggtcccgtgcgaaccggcgtagcacgtgcgcggctgacgccaggcgagccagcaccaccctgcgcagcgcggtgcgggcctcagcctggagcgcggcgagcacgaccagggcatcgcggagctcgcggaagcagccgtgcgcgtcagcgaggcggagggagtcatccaacggggaactagaggccggcgtgagactagggcctgcttccccttgtccgacctagcagacttggccgtcgtaggcttcgcgacgagctggcgctggaaccagagtgggcttgccagccacgagcagaggggccacggaccgacggcgtggcacgggtccgagatggcggcgcggcgcgagatccagggctggagaaggccgatcggtccaacagctccgtccatgggcaccggtccacgagcgagcgccgcgtcgtctcagccagccggctcacgaagaggcggaaggccagtgtggcgagcgccgcgtcggagaggcccatgggcggaggaaggcgcggagccaccggcggaagtcgtgctggtcacggggagcaaaggcgcaggtgtcgcagcggaggccatggttggtggagcccgccggctgggtggtggcggccaggaagggagccgccccgaggagggatgagcctcccgaggcgatggcggggcctaggctggcggctgtgggtgtttgaggaggatggcggctgggatgtgggaggaagagagaagagaaagggggtcggttgctgcgacggcaaggcccgtcacggcggtggtcatcgccatgactggcttcagggaacccagcaaccagacggaaaaaagaacccaccgtaggaggaggtctatggcgtggagtctcgcagagcacctcggtctgtctccggtgatggtgatgcgactgggcgaggagagactgaggtagcgcctacgtcgggcgctcgcgaccggatctcacgagggcagcaacatgaggccgaggctgcgacgtggagaaggggcgcaggagcaggcgaaggcgtcggcgaggagaggaggcgcgggctccgagaggggaggcagggacggggcggtggaggccacggaggcgtaggccttccgctcagcgagatggtgaatggcgtctcgctccatcaggtccagctactccgcactgaggccccagtcgtcgtcgtcgtagccgccccagcctccgccgccgccactaaggcccgccatttttcatggacggggtcaccccaatgcaagctcgcgataaaaaagaggaggcggctgtaggggaggaagaggcacaccaaacgtggctgcgtgggagagctccgccgctgtcgccgcgcaggcagctacgtgcaccattgccgctaggtcgagctccaacctcgccagcgagcaggcgaggtccggccacggcaccgagcggactagctctggcgcgcggtcgagctacctttaccgagtgccgccccaggagggggagcgcacggccgatgaagggaggtccgcggcggttcaaggctggggaggaggtgccctagcggcgtaggggagggaggccacccccaggagcgtgtgtgccgacgccctgcgcacacggggaaatggcagggaccgagctccaggacatctcgcgcagggaggctcgccggcctaggatggctgggagccgacggctggagaggagccgccccgggagggaaggatgagcctctcggggcagcggtgcggaagccgggcctagggcagaggtggggtggcggctagggaaagaagtgaggaaaccctaatcctctgataccatgtagaattgagtggattgatgatattgcatagagaaagggtacaatatatatactcaaccctaaccctaatgggccggcagcccaacagtggtgtcggcccacacactcacacacagagtctaacaaggacgacacagggagcgggcattgctcgcgtagctgtctacggtgcgagcaaactcgtgtgacttttgataagaaatactagaaagaatcatttagatgatggtttttagtcttgatttctgaagtagttatgtttttggagttcgataatgtaaatataaaaatactgcacaattgtacataaatgataggaattaaagaaaaatgatgacttaggtctgttgtgtgacacattaaggatcaggtcacatgtgggtatattttaccatctatatcaagttgtagaaataagttttaaattttatatcatatatcatcaaactaagaggatatcactatttactatgttttttacaatatgtcatcagaaatattatacgaagatagttttatatttagaagtgtctaatatactcactaacatctaagacagtccttatagtctatacgactctaatctatatctatactatacttaaagcaccagtttcaacggtcgtcccgcgtcatctttttacaaataacccctcacaactatttcaaattaatctgttgcacgcttatagatggccaaacggcggcccggcacgggccagacgcccgcgggccacaactctggcccaggcacgtcatgccggcctgctgactatgtcgggccagcccgttagcctgtcggcccatttaattaaatcagcgtaaaatgttaaaaacagtgcatgaggtggggttcaaacccatgccctgtgatggaagaacggcgggagacactggatgaagctgcctaaccagtagaacgtcatgctcagatatttttagtattgaatataaattgtgtatatgtatatacgcttttttgtaaaataagaaatataatcgtgtcgggctgggccagcactacgggccgtggctacagcccaagcacgacacggcgttcttggctcttgcaagcattaggtcgtttctgagaccacattgccgcaatggactccatagtgtttgaggttgctaaattggatggagcaataatgatttgtcacactaacagtaaaatgaaagattatttgttggttttaaacgttagtaattgctgcgacgtagcatagtttatatggagcgcatccagtttttattgatgcctgaatttagcaatcactccatattttgatccatcttttttataagtttgagttcatgtgacttattttagaaacctgagatcacaactttctcttatttggtctctgtatggtggaattatgtcattttataatctttgtctgttcagtcagtcgttgtgaactctcttataatcgctcacttcattggtcgtcttgtaccatgacatattgcatggagtaaataataacatcagttagccaaatcaaaaaaatattatacagagagcggagacaatcaataaaaaatcttgaaattttttggtggatagtttacgtgggtattgttgtaagccgtcgcaacgcacgggcaaccgactagtaatatctttatttgagatggtttcatatacataagtgtttaatatactaaccaaaatctaagacaatcttgtaaccttaatgactcaaaagatatatttatttgagacggttttcagtaacaatctgtcttaaatcaatttaagacatttcatacaatattactgtctcaaaacatttctttattaaagatggatctacaacaaatcgtcttaccttactcatcatcatatgataaaagatgcatctataaagtaaattgatatccatcttaaaatgtgtgtcttaaataagcttatctctagtagtgactttctggcagtttggctacaatatgaggaaagtcccactcctatgtgacaatgaaagtgcaatccgcatggcgaagaatcctgtagagcatagccacactatgctcatagacatccgaaaccacttcctaagagaccatcaacaaaggggaagatatcatcatagaccatgtgaacacccattcctaattagccaatatcttcaccaagcctttgggatgaaagagattttgtgagttgaggagtgagcataatatcttagactctcgaaatgtggattgaagtattgcacacttgcatatttttattatacctttgatcatagtgatttaattagtatggtgcttaatttattcatattacgcctatgttatggttcatagtgtagaaaatcatcagcggacctcagaagtccaagtgtactgatgcacacatttacggagaggatagtctacatttttacctttttgagactagcaatgctttcaagttaatcatgtttgtagtcttaaggtgtttgaaagggaaatgctgaatttggacaaagaagggcgcttccactgcactttggtatcaaaggttctttgcctatattcacttggttttcattgcttatatttcttcattcttgttttttggtgaggcaatgggaaagactacatagtttctctgttttggtgcttaaagctaaatagggggattagaagccaaagcaactggaccgacccccacttgagagtttttaaaagtgttttgagttttaaacatgtattttgatctaaaactctcttgatagcaaagaggagctcacttattgtggaaattgcttaatgttgattttttgataaaaaagagttggttagtcaaaactattttgattcacaaaactcaaactgtatttgacttaagaaagtgaaaatattgagaatgacttagtttgcaaaaccaaaaacaagtggtggctaaaaggattgaatatgccaaaacattgaaaaacttattatttttcatctcaactcagtttgaacttcaaattaaatctctcctctcatattgcatatcaaacttagttgtgttggcataaatcaccaaaaagggggagatttgaagggaaatgggcaagttatccatttctacatgtattggtgattgaatgtcaaacacaacatcatggactaacttgtttcctaagtgtatgagtataggtttactcggatacaattgaggaattctaagtccaaatgaggttaaacaaggccaagtagtgtaactttgtgaaaaagggtaaaactatgaggtttgaacctttagatatgttgcatatgcctattacaatgtttctagcactttggtttagtctctaacttagtttctagagaaaagtgcattttggacttagtttgagcaaaaattgaaatcatagtgaaaagttgagaaagaggtgagtttctatcacacccagatttaaggggcaaacccgggtgcgtctcatatgtgtgccaaacaagatcaactcatataatgacttagtgtatagagacgaatgtcacagactttattacataacgaaatgtcttacaaaataactgataataaatagaataaactaatatctttattatcccttggcgccatcaagctgactaggtgacgacactgttggtcacttgttctcaaatgttgtagatcaagaacaaggcaacacaattgttatttattatggaccttcatcctccgaagcattattagcgatgtctgtgatgcataaatgtgatgcaagcgattgagcagacgccgccctcagctttggcggcaaaagcagtgatgcctgtcgataccgaagataccgcaagagctgaagctgatgaactcgcaaccacaatgtcggaaatcgacagactcatatcagatgtggttgtcaaggaaaacgtagccgcagtgccttacaagggaaaaagaagtgaagatgcctcttcggaagataaagattttgaccttcggtacttgggtgaccaagaactttccgaagaggacaaatcagaattgaaagagtttgttataccctgcggttaccagcctggattcatactcttcggtggggttgacgaagagatttggggatccattcgcaaccgtgccggggcgaaaatcataaacaccttatccaagagtattggattcccgaagctggaaacgaacatcatttgctataggcggcaacacattattggcagcttgttctactcaaattttaaagtaaggcttctctacagctccctattagcaccttcgtggtgatttgggtattctaactttgatttgtttttcagagtctgctgctaagcaaggccttgaagatgcagcaggatgtcgaggacacaaaaaacgaaattgttatcgaaggctttgaagataaaatcaaaaagctcaaagattccttgaaaggaaaagacagtctgctacgctcagccgaagattcactcgccgaagcgtgatctcagaatgaaaaattgagcaaagagctggacgaagctcgaacaactttggaaaagaaatcggagcgcttcgaccacgagtccaaagcattgaatgcaagagttgaagcagaagttgaaaagaacgttaaactaagcgagataatcacaaatcttcgatatagatgcttcgactttgccactgaatgcattgcccggttgaaggggatattcaattctgtcggagccgcatctgaagaagttacccattctgccgaagatattcccagagccctcgagcatattgaaaaagaagttgaggccctcgatgaagtcataactgggcactcagatttctgtgcacttgtggcttctcgtggcacaactgcagctttcatgaaggccggatgcaatcacgtgagggccatcatcatgccaaacttcggcctgtcaccgtctgatctagttgatattccggtcaaagcctagagtataggtaacagatttatcactcaaatctgggtgaagggcggccgcgagctggctagagacgaagctcgaaacctgctcaacaaagtatagaaaatctctttaccattaggcttttattttatattttcccttaccatgttccttattacccttgtttttgtcctttttcagggtgatggtgccgaaggtcaatgagccgaagctagctttgaagcgctgaaggccttagaaactccttttgctgacatctatagaaacacttggaaattctttgtacaagagagtgtattatttgataaagtgttgtaacgaaaagcgaacaaattattataaatgtttgtaatgctatttaacttttgtttgtatatcatctgctttgttgtggacgaaaccaaagcttttagatttttgagccgaaggcgaaaaacaccttcccttcttttcgttcacatcgaagcatatttcatatacaacgaagtttcctttgagacgaagcatcttcgtatataacgaagcgttttattattgaaggcaggaatcctcgcttttcttgttaatgcttcatgctttatgtgatgatgatgaacctatgaatgcctaatgtatggttgtatgaatgcaaaagatgatgtaatgaagtgtgcaaatgtatgtcgaagataaaaaaactcacacaaacacacaccaagactctgcatccccttaggaacgactttggagtctcttcaccttttacttaggtggtattttagctttgcattgccttaggaacgactttggagctaagctctgcatccccttaggaacgactttggagcttcttcaccttttacttagctggcatcttagctctgcatccccttagggacgactttggagcttcttcatacttttttacactcgatggtgtaatcccagattttacattttacatgtgggggaatttggcccttgtattgcacagggctgcacaagaaaaaaatgaaaattacaacctatggccccattaaaaacttgtctcccctctgaaaggaaaagggtgccatagggaaaaaataggaaaattacatagtttacacataatatcttcgaagttcatccgcattcaagaccttggaatgtcattgtcgtccaagtctttcaatctgaatgatcttggtcttgacgaagatatcaccaagaagggaccttcccacttaagccgaagcttccccactgtatccagtttggccaccctccgaagcactaggtgccctggcctgatgttcttcaattttaccttccgatcacgccatttaattgtttcgtcctgatacttattgatgtgtctactgcttggatcccggtcccttctatggtgtcttttgttattttgcaattctcttcatcttctgtcgaagctaaggtccttattgagccccttcttgcttcttccggtgttattgcttcgtcaccgaacaaaagcttgaacggggtaaaacccgttgactttgagacaacagtgctgtggttccacaccacctttattaattcgtccagccattttcctctaggctagttgaaggttgacttcattatccctgttattatgattccatttgctctttctaccagtccatttgattccggatgtctcactgatgcaaagtgtatttttgtactgatctggtcacaaaaggctttgaatgttttggcatcaaattgagttctgttatcaactgtgatagccttcggcacaccgaagcggcaaacaatattctgccaaaggaacttctggactgtggctgaagttattgtagctaggggcttagcttcgatccacttcgagaagtactccactgctaccacaacgtatttcaagttttcttatgctggtggaagtgggcctagcaaatctaggccccacctttgcagtggccaggtgggctgaattagttgggttaaagacaaaggttatttctggtctctggcacacttctggcagttttcacatttttgaaccaaatccgctgcatccgaagctgccttcggccaataaaaatccttgtctaaaaaccttccccagcaaaggcctagacccaatatgagctccacacagtcatgcatgtatctcctttatcagctcttgacctttggttctagataaacattttagtaatggagagcagactccttgtttgtacaattcttcgtctatgattacatagggtcttgttcttgcttccattcttttgttgtaagcttcgtcatccgaaagacaattgccttggaggaaagatacaatctcagtcctccaatcttcgttgtgcactggcgagattgtaagcactgctctctccatgagctcaacagaaggtgcttttattgtttcgaaaaatacctccgaaggtaacggaagcccctatgccgctgacttagctaataagtctgcatgttcattttctcctcttggaatgtttttacagagaaaccttcaaaagaggcttccatccttcggactgtgttcagatacttctcgagcttcgggtcccttgctttactacttttgtcaacgtgccccaaaatgacttgtgagtcagatttgaggattgcccttcttattcccattgccttaagtttccgaagcccaaagagaagggcctcatactctacaatgttatttgtacaattgaagtccaaccttgcttcatagcaggttttgattttagacggtgaaattaaaacggcagctgctcctgcgacgaaggttccccatgacccatcacaaaatattgtccaagcttcgatatcgtttgttctctcttcgtcttgagcccctggcgtccaatcagcaatgaagtctgctaacgcctgggattggatcgaagatctatgaacgtaatcaatagtgaattcattcaactctgcagcccactttccaactcttctggtggcttctctatttctcattatatccttgagaggttgtgaagaaggtactatgatatggtgcgtctggaagtaatgccgaagctttctggaagccatcagtacaccatatagtaccttctccagctctgtgtatttttttcttgatgggctaagtacttcggagacaaagtacacatgcacttgcttctttgcctggccatattgcttttcttgcaccagtgctgcactaaccgcagcgtgggaagtagctacatacagcagcaacagagttcctaacgaaggtggggttagggttgttaattctatcaaatactgctttagttcttcgaaggctttttgttgagttggtccccattggaagacttcaactgacttcagcacttcgaagaatggcaagttcctctctactgatcttgaaataaatctattcaatgatgtcagccttcctgtcaacctctaggcaccctttcgcaacttccgtggctccatccgaagtatagcttctatattacttggattggcttcgatcccctttgttcataccaaacaaccaagaaattttcccttcttcactccgaaaacacattttttctagatatagcttgagactagcttttctgaaattagcaaatgtttcttgcaaatcagcaatgtgattttcatgcttcgtgcttttgactatcaacatatgtcagcacattcttgccaatttgggagtggaggactttggcagtcatcctgctgaagcttcctcctgtattcttgaatcccttgggcatccgaaggtagcagtaggttccacttggggttatgaagcttgtcttgggttcgtcttctttcttcatccaaatttgatggtagcctgaataacaatttaataggctcattatctctaaagtagttgctgcatccaccagagagtctattctgggtaaagaaaactcatccttcggacacactttattaagatctgtgaaatcaatgcacattctccactttccattagccttcttcaccattacagtattggctagccactctggatatgttacctctgcgatactctggtactcagaagccttttgactttgttttgtgcaccttcggctttgtcatcggacatcttcataagcttctgcattcttggcttgatagctggatcaacattaagtgaatgctcaatgacgtctctattgacaccacagagatcattggctgaccaggcaaagacatccttgttattgaataaaaatttcaacatggttttttcttattctttagacagttgtgatcccagcaacaccttctgctcggccatgtcctcgcatagaagcatgggctttgcctggtctgctgaggcagtgaaagtcgcctagagggggggtcaataggcgaaacctgaaatttataaacttaaacacacactaaggtcgggattagcgttagaattaaattcaagtacaaagagagggggaaaaatcaaacaagaatcaaggcgagtgaacatggtgatttgttttaccgaggttcggttccaaagaacctagtcctcgttgaggaggtcacaaagaccgggtctatttcaaccctttccctctctcaaacggacacttagaccgagtgagccttttccttaatctctcgggtcacttagaccctgcaagggaccaccacacacttaggtgtctcttgcttcaattacaagtcagttgagaaaagaaatgagaaaggaagaaggtaatccaagcaacaagagcgcaaatgaacacaaaatctctttctcacaagtcactaagtgtttgagatgaatttgggacttggagaggatttgatcttttgaattgtgtcttggagtgaatgctagagctcttgtattgaatgtgatcttcagaaaacttggatgccaaaggttgtggtggttggggggtatttatagccctcaaccactttgtagtcgttggccaaggctattggcgatgggcacaccggacagtccggtgcgctaccggacagccactgtgcactgtctggtgcgcgccacgtcagcgtaaccgttagggttcggagccggtcgaccattagagcttttgtcttttagctgcaccggatagtccggtgccacaccggacagtccggtgccctctgacattgctgctctgacttttgcgtggcactgttcaccactgttcccatctgcgcagtcgaccgttggcgccagagagtcgttgctccgctggctcaccggacagtccggtgaattataacggagcacgtgttcaaactcccaagagtggctggtttggagttgtacggccctggtgcaccgaacggtgtccctggcacaccgaacagtccggtgcgccattcttcagcacactcaagtcttttgctccatttttgattgtgtccctaaccagatttctttattggtttatgttgaaccttatgcacctataatagataatatctagacaaactagttagcccatgtgtttgtgttgatcatcacccaccaaaattaattataggaaatgattaacatgatttccctttcaggcagccttatctcttttgtgtttgtactgctaatgagcttcgtcttcatctatgttatggatagcctttgaatctatccaattcccttcggcccttctagcagcctcttgactcccttgcacaactatggggcttggtccaattgtatcttcatgcacatatacgctggatgaagtatattgcttcgaaggcatttaatgttcctcgcccaatgattgcattgttgggatactccatatcaaaaatgtcaaagacaacctgctctatccttgtgttgtgaacatagccgaaggtgatcggcatagttatcttgccgagtgtcactatctgccttcctctgaagccatagagggggtgtgttgcatcatgtatcttgtcatcctgctcttgcatttgcctgaaagctttcacaaagatgatgtctcctgcactgactgtgtctataaggacattgtgaaccaggaaccccttgatgacacaagatataaatattgcatcattgtgaggataatccttgaggtgaaggtcttcctgggagaaggtgattggtatatgagaccacttggacttgataaagggtccttgcactccaacatgttgtacccttctctgtgcttccttcttttgcttcttattggctggttcagaacttgagccgcctgtgattgggagcaccagcttcgtagccgaaggtaccacagcttggttgccttgcgaaaagccattgtcgcagtcgtggaagtgagttcaccggaggtgggcgccaatgttggtcacttgttctcaaatgttgtagatgaagaacaaggcaacacaattgttaattattatgggccttcgtcctccgaagcattatctccacatgggaataatgctcatcagacgaaggtcaagaaggacttaccttcattatttaatatgtgaatgggaatgtaaaaggatgaagattgtaactgcattttattaattcatacatatttgcatttcataaaacatgtatgaatattgacagcattaatattacattggtaccttcggcttgctcgaaggtgaagacgtgagagagtgattacaattcaacgtgaacaatacgatgttactgttcatctatttataggcatgggacgcagcccgggtaaaattacattcctgacccttaacattcatctacagacgacctagattattaaggtctatctggttttttacttcttctgcttgagctgaatcgaagctgatgataacttcggcattttgcatagttgcttctacgcaaggtcttcgtcttaagaagctgaactaaagctgatgatagcttcagtggccctctatatcattttgctgaaggtgtttttgtcttgaggaccttcggcggggaagaagaccccccaacagacacctagacctcatcaaactcgtcatcataatcctcctcgggtggcacctgctcttcacctgtgggggagttttattgcaatagtgagctcatagatgttcatcgctcagcaagtgtgggaaatattgtgcatgagctcacttacggtgggggctcatgtatagtgtaaggctgatcaacaaataatggttaaggcagagcattgcttttaataagctggtcaaattttattagaagttactaagtataagtaaataccatcctaataaaataagagatcacaattaataataaaacccacaatgcaatgcaatgcaaatgacagattaagtttaattccatatgttactaatgtgagtgtccgagccgctcatgatcgtgagcacggatggtataccagttttacactctgcagaggttgcacatcttgacccacaagacatgttccctttgttgcctcgggttgattagacccttaaacactgccaaggtgagcaggcgagggtacactgcgaggcctttacaaagttccactagaggagagaacccgctacagtttccaggccgaaagcggtataggaatccctcgcctgaaaaactaaaaagatagttcgatccaaggacatccctacaccagcactcttccaccccgattgcccctttcgggaaaaggttaactcacactagctttcctaattaatcagccaagggcatcccattccacccttgtgatagcactgttttcccgggtgatcgctgtgggggacagatatcccctgggtccactagaaggcaaaatatctttgtatgggaaggctatcttgtcgtgggccgggcaaagactatgagtggaatgggctgacccgagaagacaatggactcgagcccagattgttcgtcaaatcgtgcactaccccaagaaaccgtccgactttcccgcgactggcaccctcagatgttgggatggttcaaggaagagtcggcgagttttttgaagattatttaagtcggttcgctattagttaggagatatactggaagaacatcatcgccatgtacgtagggagtgccccacggtcatgtatataaggcccagagggaccccatcattttcatctcatctcattatcccttctccattcaagagacaccacttgtaacacaccacatatacagacctgacccaggaagtagggtattacgcctcttaaagcggcccaaacctgcagaaaatcatctgtctctctctttttcatgcacctagcacgaaccattgagctatagtcaacaacatcgtcctacccaaaagcaccgcaagggtatccctgggtgtgcggtcggacactaaacaccgacagctggcgcgccaggtagggggtgtgtcgttgatcagagctagctcaatggccatcaccttcaagtgcaagatcgctcttcgccctagaactatgtcctattttggaaccatctcgtgcataccagacaaagagggaactatgcatcacatagcgaatccacctaagaaaaaactttccttggggatcccgagggaagccagagcaaaacagtgggtggcgccaccgcctgaagctcggaggaagatgatccctcataaaccgaggatcgagaacccttgggagaagaaagatcgaccggtcaggatttcgcttacccaaagaactccgttgtccaccttgcctacaaaggagtggacgcggatcattcgaaagaaggaaacaaatgtcccgagtcagggggatgagaacacgccaagccacctttctgataccttcgccctcaaaggaggacggaaagaagagcaccgtcgcgccggctcccttttaccccgacgtcctcttcatccaggggagattggagtcagcacccgtctccgacgatgagcctaccatgcaaagggaagagcctccccagcatgaggcgcgacgatgaaggaacagacaccggaacgtacggcgacatcatgaagctggggaacgagatccggtgtagctcgtatcctgagatgaagcctcagagatgggagaaactcccgatgagcgagtgcaccgagaaaggtgtaactctcgccgccgcgatcagcgataagctcaggagcgggagctagctgagtaggacgctaggctgcggtgagagaaccctctcttcgctcggaacctgtatcccgattttgctcgagcaatgaacaccccgagtgaagttagaggggtactggctcagatagctaacggtctcccgcgaaccccaaacgcggaaggctactggcggctgcttacccagacagctaatcaccttctacccctcgtccatcctgcgaacgacatgcgtcataagtgttcaattcttcctctccaccacaccattttgttgtgggtgtagggaaccgagaactcatgtttgatcccttcttcgcctaagaactcatcaacacatgtattcttgaactatgttctattatcgcttctcactttcttgatctttagctcaaactcattttgagctcttctcataaactttttcaatatttcttgggtttcacctttatcactcaaaaataaaacccaggtgaagcgagaaaaaccatcaacaataactaatccatacttactgccaccaatacttatgtaggccataggtccaaagaggtccatatggagaagctccaaaggcctcttagttgtgaccacattccttggttgatgtggaacgccatgttgctttcctgcatgacatgcgccacatatcctatctttcttaacataacatttgttagtccaatgatgtgattatccttttgaagtttgggcaaattcctcatgccaacatgagctagccagtgatgccaaagccatcccttgtcggattttgccactaaacaagtcttaggcgtcaccttacttgttgtgaaatcaacaagatagagtttgcccttcaagcgacatgtaaaagcaacagaggaatcctctcttctaaggattttcgcatcaacattagtaaacaagcagtcatatcccattccacaaagctgtgaaatgaacaacaagttataacttaatgaattaaataacaaaacatttgaaagcgattggtggtcagtgatggagatgttaccaataccaatcacttcactcttgccactatctccaaacacgatttcttgtgcttcttgagttagttgcaaggagtgaaacatgtctttctccccggtcatgtgatttgtatatccactgtcaagcacccaccttgacccaccaaaggaatagacctgcaaaacaagtttatgctatgcttttaggtacccaaattgaattgggtcctgcagtgttagttattgccttgggtacccatgcactccttttcataacctttctcttagtgtaggcacccacatatttcacaactaattttcctgaatcccatgttaacatatagtcacaaaggtaggagtgagagataggaactttagacttctctccatttgtggaggcaatattcttcatcttatcctttgtgttactcaagttcacctttacttgagttgacttctcatttgaagagtggatcctccccaaggcatcatatatggtagttccttctatgaacttaggggatctccaccccttatgctctatgctagggttcagcttgtatgtgttgtacccatgtcccttttttccattgttgggcttcaacggtttgtacttgggttcaactttcttagacccatcattgctagagcatttcttcaatatttgcttgacttcaacctttgagttgttcttcctcgcatggttagtcaagcaacaagaagcatgatattttgaacaatgtttacaagtattagagtcggaggagctagctttagaatctaacactaaagacgaagtggtgaagttcttgcatgtttcaagttgcacttgaagttcttgattttgaaccgttaagcttgataagctcgattcaagtgcttcttttgcatttgcaagactaactatagaggttttagcaacaacaatttctttctctttatcctctatagttattttgactaaagacatttccatagtcaatacttcaagcatttcatccttattggatagtgacccttgaagttctaggtttctctccttttcaaggatgagtaagtcttattgagcatcagggttgcttttcttttatctagcttctccattagtttagtggttacattatatccatttaaactaaattctttaatcattttatttttcatagcaagttgatcatcaacatcatcatctgcaaaatcaacattaaataaatgtaccttatctccttttgccatgaggcaggtaggagtgtaggagtcatcggagaggttggtgaagagtcacgaggtcgaggtggattggatggcgatgtttgccacctcttcctcttcttccgagctagaactctcctcgtcggagttccattcttcactgatgtgagcttggtcatacttcttcttcttgaagtatcccttgcttttgcctcccttcttgaacttgtcctttttgtggttcttcttagctccttgttccttcttatttggacaatccgctatgaaatgatcggtttggccacattcataacatgccctatttcttcctttcctttgatatttatcattctttcttacaaatttcttgaaagtcttgataaacattgaggtgtcttcttcgcttgagctttcatcatcactaaaactttcaacaattttcttggatttgtgatctttgcccatcaaactctttttggaagattcttgttcatttgcaaccaaggcatgagactcccttgtcttggttggagcatcctcagattcatgttgttggatcttagcaaataatttatgaggagtcatcttctcatagtcatctcgatctcttatcattcttgctaagctcttgtccttctctttgtaggctctcatgaaaagcctagtgactttagagtcactccaatcctaacttcctaagactcttatcttgttaacaagaaccatcaatcgatcaaagagaaattagagggactcacccttaatccaatcatatctagcaagctcactttccaaggcttcaatattatgtctcttcgctttaggatctccttcatgtgacattttgagaatgttccaaatatcacgagcatcctctcttccttggactttccaatattcttctggacacaagcttcctttgatgatgctaaccgcttgtgcattgtgatgcacctcttgcatcattttcggcgtcatcccttctccttgggcgggcttgttcatacctatgttaacaatctcccaaagactcaatgcacaccgattagatgtgacttcatcttatcggcccactcatcatagttcaactcactaagagttggtaactttccaagtggcgctgaagagaagttgggaataaaattatgagagtaatcaaattgaactttattgaatttgttacctttacttttggtggatgacccttcggtggtgagacttaccttgctcatcacctttgacaccaaaagctctaccaagtcatcattgtattcaattcttccctttcctttatcttcttcggcctttcttcttgattcttcttcggcccttttctttgcatgttcctctttcatcttgaggaacattttcttggcaatcttcatggtgaggtcgaggaccttggggtccatttcctcaccagtggatgtggtagggatttcctcgagaaggggatccacatggtccctttgtgtagacatgatcgtttcctcacgtggttaagcgtaaaatgaggcacgaagctttgataccaattgaaaatagcctagagtggggtgaataggctaacctaaattttttcaccataaacttcgaaatattgttagatctacagttcaactggtgtaggccagttcaactgctacatgggcaagttaaactactctgaaccagtccaactgttaaagtaaatctagactatgaactatgcgaaaaatatagtgtgaatctatagggggaaaatgcaattaataggcaaagtgtggatggtgaagatttgagagttatttcaccacaagatacacacggcgagtaaacctatatgtatatcttgccaaataagacctcaatcatagaacgagcaagaacacaagtcacaagatttatcccgaggttcaaccacaccacaaaaggtgtcctacttcccattgaggagcccacaaagggctgggtctttttcaaccctaatcctccataacccgaccaccaaggtcaagggattctttatctcaaacgttgctcacaagagcggggattacaaacttcttggggtcatccacaaatttggagactcccaagtaacctcaaaccgtcttgaatcctagggtttcaagaacaccaaaaaaaaatgcacaagaggtgtttgcaacaagctcaagagattagaatgagatgggagaggaaaactaaatccgtgagcacaagcacaaacctcacaccaaagggctccttcaaccgagttgaatctagagcaagttttgggtgagagagggagagaagtgtgcctttgtctcaagttaggtgagcaatgaatgtgggtgtgaccagcaacattaaagattggggtgtggggtcctatttatagtcacggctcaaaactagtcgtttgactagaattcccgaccccaaatcggttgaaccgcccttagcagacctggcagtctgtctaccagtctgattggcaaactgctgcacagtctggtcaaggtgacctagaccggttgaaccgcccctgacagctctatcagcctgtctgccagtctgactggtagactgttggatagtggtcagaggggtcagggaccagttgaaccacccctggggaccagttcaactggtcttgaccagagagttcaggagagaaaaccccagttcaactggcccagaggcaagttcaactggtgtatgttcaaagaggttcacagttgaagttcaactgtagctgaaaaagctcaactgcagctgaagaagctcaactcagctgaaaaagctcaactgcagctgaagaagttcaactgcttttcaacaagaacactctcagtttctcaaacccaacaacggtcagacatagagcgttcaagagattttggttttcaaaaatagcttttaaatttggaggcttgagctatagcaaacaccattacctgtgcgaaaactactaaggaagaattaaatcatgtgactcaagatatacataaaattttatacgtccgtcgcatggagtcttttcaagggtaccgcatatgtgttttctgttgtccttgaaacttcctatttgacttctcaacagttgttgtgactcctttacttcctatacattatgagcatatactaggagcaaacttgttagtacacttatttgttttgtcattaaatcaccaaaaccctcagttatggttgattgcacttatagcccgagacatccacagagtcattaacatagatcaaagtgcgaaaacaaaacatagctaaacacggccttcacaggtagccgactgggggtttgccgctaacccacatctagaactcctcatagtcttggaactcctagaaatcctccaccacgacttcatcttctcctgagcagtggttgcaatgtggacaacctggggggtttggtgttgtaaagcaagggtgagtacacatcgacatactcagcaattgtcccgtttggctgtggtggactagctttatgtggggttaagatcaagcagttgcttttagttgatcaggtaattatttctagtagagagccagattttagcgttaaacccaagtttttagcccaaaagtactccttccaaacggaaagaatagcaggaaccataatcataatcatcaaaaccataagtatccccatcatcatctgtaatcatagtatcctaatcaatggagctcccaaggtcgccactcataaccgtgagcacagctaatatatcagtttctaacactatgcagaggttgcacactttacccatgagtcgtgattcctttttgtctcgggccgatcaaacccttaaacactaccaaggtgaataggcaaggtttcactacgtagcctttacaaagattccctgaggttgtagccacccgttaggtttcctaaatgtactgcactcctccacaaggggcaaaccaccctcggcagagcgagccgcatacaccgagcctcattgacgacacggcgacgaagcaaactatacctcagttcctctaattatttggctaagggcataccattccaccctcatggttgtaatgttttcccgggtggtcatccaacgaaccagtccttacggagaggcactcgagaaactgctcgagcccccttaaatgtcacaatgccatcatcataatcaaaaggtaaacatcctatcataaataatctcatcatgttcattgattaaagtaaagcgctagcatagagcgacacaacgtactactcgaacgggaattaaaaggatcgtcgcgcgacgaggcgcacgacacaacacgtgatttaaacggaattaaaaatggattgtcatgcgatgaagcgtgcgacacaacatgtaatttaaactaaaattaaaacggattatcacgtggcgaagcgcgcgacaacacacgcgatcaaaactgaaattaaaacggatcgtcgagcaacgaaaagcacgacaccacatgcaatctaaactgaatttaaaacaaattatcgcgcgacgaagcgcgtgacacaacacatgatctaaactgaatttaaaactaaatttaaactaaatttaaatgttacgatgcgctagggctacgtgcacggggcagggactgcgcgcataggacagggccgcgcgcgccggggggcgggccacccaccgtgtccgcgccgagccttggctgcgcgctgcaaccacgagccgagggtcacgccgaggccgcgcccgagggtcgcgccctggccgggccacggggcatggggccacgcaggggaggggatcagttagtgaaggagagagaggggaggaaggagaggggagatcaccacaggctcgacggacagcagcaaccgctcatcgggatccaacctagggcaaggagtgaggtggagagaggtggaagagagggaggttactgcgcgggaaagagagaatgagggggaggagggcgcgcatagggaggggtggggcacctcggcatgcgcccagggccgggttgggtcgtgggccggactcactaccctctactcgatctcgcctgctactaatcgatattattccgtgaatcaaaaaccgaaactagacgaacgcacacctaggcacaacatcagacaaaataaatatgctccgtcatgatgcaacaacaatatcaacttaggttttggttacacgcgatacggacaccagtctctatattgatttgaaaataggaggaaggagcgaaacaggaagagaaaaagagagtaacgccagaatttggtgaatattggagaagaaaatttatacccccaaattcagggcgttatagaaggcactgcgaatgctttgtctcgcgaaggctgtcggcacttcgaagcttttgaccgaggcaatgaggaccttgaccgggaggtgttctaggtcaaagacgctgtactaaaccggtctgctggggcactgtatgatcggatgtgggggcgcatggtcgcgctgttgtcagggaaagggttggtcaagcgttggagcatgtgaaggcctttttctggtcgggggtagaaaattgtgtttaaatttgagatctctaatgctttgttgttttcttaccgcatgagttgtgggacgaggagattgagaaccttgctggcttggagtgttccctggccacccaggacggtggtgttgccgagatgggtgcgaaggagcgatcgtcccgtgcagaagctaaccacgtcgatcccagtgcggcgaggacttcgctccctactactgatgagcggctgtaataggagtagactttttgagtgagtggcgcactacctcgtcagattctaccagtgtagacagctgaaggggtccttggcccttgtcgttttgaggatcaggagcttagggcgctctttgaaggcgaagagctcgagctcatgttgtttaattttcaggaggtcggtcttgttatgaaggaggatcttttgtaaccctaaagaatacgatatgtgtattgtcgttgcttggcaaatttttagagcggaacactgccctcgccccctttgcccaatgatgactatattgcttatggtgtctggtgagtgtgttcgcacactttttatgctaatctagctgcacccttaggcaactcttatttttttgtttggaatgtttgcatctaataggacgactttgcacccttaggtgtcttcacgtagttttggcgctaattcggctgcacccttaggcgacttttgctcggaatatttgcgtcttctaggaagacttcgcacccttgggtgtcttcgctcactttttgtgctcatctgactgcacccttaggtgacttttgctcaaaatatttgcgtctgttaggacgacttcgtacccttgggtgtcttcgctcactttttgtgctaatccgactgcacccttaggcaacttttgctcggatgtatactgacttcgcacgtttgttgtgtgtatccagctgcacccttaggtgactttttctcaaatgtatactgacttcgcacgtttgttgtgcgtattcggctctagccttaggtgacttttgctcggatgtacaccgtcgccaacgatggtttgactcgcgccgtcattgtgacttcgcttggtgttgtatgtcgaaggtgatacgaccacaccattaagcaacacattacaacccccaagtcatactacatcaactcaagtacaaccaacatcatcaccaacccaagcctttgatggaccaattacacgtagccgagctaagaagatacagcaagaggtgcacgcgctactttatgaatttcaattaaacactaatgagagctttatgctacctaagtcgtgtatgttgatattacttaggttcaccaaagaggaaggagaaaacatattaaggacgagtcaacaagaagagctatgtccgagtcagtccagcgcaacagaaccgttcagaagaaacagtcatatcttttgattcccaaaatctatgaaggcccataagtactttttggaaagctcttgaagtctagtttccaatgcttctaaagccgacttaatcaaatctaccagaaaggcagccgacttactttagtgccgactggttagaaggtcaacagtcagcttgatgaccaagtttttgtattgaactgtatcattctacgaagtttcattaagcatgttatatatggtgagaaagattatcaagttagctttccaacgcaaccagtcccacgtcatttggagattcctagaaaaagttattatcaaaatactgaaggctgcgcagaagtcaaacagccacacggaattcagttctgcagatctcccgaagaggctccttcacattagcacgtgaaattacttttgtttcgtgtttatacctcgctaaggctggttgttactagtataaatacccccctatgtctatgatgtaaggtagcttatgataatctaaaatagaacccctttgttcagctgtgtgctaacaaatattgagagtgatctctacccctttgctcttgtgaattctttcgcgggattgcagaagcggcggcttcatccgctcccaagtggtgctcctactcccttcgaggtctcctcgattgattgtaggctgtgttggttggttctttgagagtgtggttgggcgaatcctcgattcatgctgcccggttaaagacggtggttggcttcgagttttatttgtcaggttgcactagttgtcgctgcttgcagcaagttatcttggcttctttgaagctagttatataaagattgatcctacatcgtgaagattaggcatcatgacgcatcatctggtatcaaagcctcagttgccacggtaggattctttacccttagctacatatatcttgtattcgtcctatccaccaaaagccataaaatattttgccatagccctttgtttcaatctgttgttctagtgagttttgttaagtttcagtccttagaatctttgtttagttgctggtcactctatcctttgtgtttcctttgagcctcttatatatatatatatatctgaaaatatccacaaaaagaaaaatctgaaaacccgcatcatttccttcacgttaactttgatcctatttaagttatagctgctagttgagttctttgttaattattataaagtgtgcaatatcatattagatctctgtgtttagttctataaataaaagagtatcaaaaaaaagagaagaaagaaaagtgccaaagaaaagtgttgaacaagattgtgaacaaaaagtagaacaatcagtttgtttatgtgcacaagtgctgaaaattttatcaagttgttcaaccagtttgctattgtcatttggtgcaaaagtttggttggatctgattgcaacacttgcattccaatcatactccttgtctgcatcaaatctgaaatttcttgcacgtgtgttgatctagttacatcactcgtatctggtggtcagcactaggcagggaactttctagttggatggttattaacttacaacaactaggattcagattgcatcccttgtttattattccccaccaaagctccacatataagccatcgtaatcggtactctggtcattgtattcgcttaaccaccactttattgttaccaccacacattttctcgcaacccgcagggaactcataagagctttggttggtaagagtggtgaggttgtgagattctatatagcttcatattccacctatatttgttgccttgtcgccaataatttcgcaggaagatggatcccaacgttgagattgaagaatgtgtcaccatgatacaattcaatgagctcaaacaaagcatagaagccaagcaagatctgttggcacaagaccttcagacacttatggctgaaatcagaggtcatcgtcgactccctgacggtgtaagaaaccatgatgaagatggggaagaaggtgaaggaaattattctagaagggcaagtgaacatgggaggagaaatcaaggtgctgcacgtggtagaggaagaggccggaatcgaagaaatgatgacaatgaagaatctgaatttggggatgatgatcagtcccaacgtcgctatggtcgtcgtcatcatagaggcgtcaaccaagaagagagatttgggaaacttaagtttaccatgccaaaatttgatggtagatctgatcctgaagattatttcacatgggaattgaaggtggagaaaatcttccgcctacataattattcagaggagaagaaacttgcaatggcatctcttgagtttgaaggatatgctctgatttggtgggaacaacttcttcgtgatcgtgaagaagatggagatgaccctattattacttggcaagagatgaagcgagaaatgagaattcgttttgtgccaaagcattatcggcgtgatctttttgataaattgcagaatttgaggcaaggaagtttctctgttgaggagtattataaagagatggagaaggccatgattagagccaatgtgtatgaagatgaagagcaaaccattgcacgtttcatggctgggttacaccgcaacattcagcgtattgttgagtttcagccgtaccaaagtcttattgatttggtacatcaagccaccaaagctgaacgccagctgcaacaagatgctaagagcagcaagcccttgtcatatggtgcacgaaccatgactggaggaagcaaatcgatctcaaggtttactgctacatcctcagcgacaaaaggttcaactggaggcttgcgatccaatattcaaggcgattctagtggaaagaacggtgctgctccaaacacaagttataaaccagcagcatccacttcaacatcagtgggttcaacagccaagagtagtggtattcagtgcttcaagtgtggaggtcgtggtcatgtcataaaggagtgtccaaataatcgtgtgatccttgtgaatgatgatggagaatatacatcagctagtgaagaggaagctgaagcagaaaatgtagaagataaaattgaggaacacactggatgtgaatttgagcatggtactactcttgtggttacacaaatcttgagtgttcaaatgaaagaagcagaaattggacagcgacataatctttttcaaacgcgagccaaagtgcaagacaaagtagtaaaggtgatcattgatggagggagctgttataatcttgcaagtcgtgagatggttgaaaagcttggtttgaagttgcagcgacaccctcatccatatcatgtccaatggctgaatgaatcgggagatatcaagattggttataaagtgaaagttccgttcaagattggagagtatgttgacatagtggagtgtgatgttgcacccatgtctatgtgtcacatgctgctaggaagaccttggcaatatgaccgatattctcaacattgtggaagaacaaatcaatacacgctagatctgaaagggagaaagtttgtactcaagcctatgacccctcaacaaatcatggctgaacacttacaaaagaaaactgaaattagtacaacaagtagaggaggagaagagcaaaagaaattgagtgccatccataattcggtgagtgagtgctacaagccaaattccaaagataaaaagaaggaagagggagaacatctagttatgctagccacaaaatctgagctgagagaagtgaggaacaacccatatcaagtgctctttgtacttgtgaacaaagatgttttgatttctcctaacgacataacatctcttcctagtgttgtggctgatcttttgcaggactttgaagacgtatttccacaagaaacaccggctggactacctccaattcgagggattgagcatcaaatcgatcttattccaggggctgcacttcctaactgtccaccatatcgaaccaatcctgaagaaactaaggaaatacaaaggcaagtgcaagaacttcttgataaaggttttgttcgtgaaagcttaagcccttgtgctgttcctgtgattttagtacctaagaaagatagatcttggaggatgtgtgttgattgtagagctataaataatattaccgttcgctatcgccatcctattccacgactagatgatatgcttgatgaaagtggttccacaatttttactaaaattgatttgagaagtggataccatcaaataagaatgaaaaccggagatgaatggaagactgcatttaaaacaaaatttgggttgtatgaatggttagtgatgccctttgggttgactaatgctcctagtacttttatgagattaatgaaccatgtcttaagaactttcattggaaaatttgttgttgtctacttcgatgatattctaatttacagcaagtcttttgatgaacatgtgaaacacattcgacaagttttagatgagctcagaaaggagaaattatttgctaatcttgagaagtgcagtttttgcacaggccatgttgtgtttcttggctttgttgtttcagcaaaaggaatagaggtggatgaatccaaggtgaaagccatcaaggattggccagctccaacgaatgtaagtcaagtaagaagttttcatggtcttgctggtttttatagaaaatttgtgcgagatttcagtaccatcgcttctcctttaaatgaagtgacagagaaaggtgttgaatttaaatggggaaactcacaagaagatgcttttcaagaattgaagaaacgtttgactgaagcacctgtacttattcttcctgatttcactaaaacttttgaagtagaatgtgatgctagtggaattgggataggaggagttttaatgcaacaaggaaaacctataacatattttagtgaaaaattgggaggtgctcaattaaattattctgtgtatgacaaagaattgtatgctttggtccgagcgcttgaaacatggcagcactacttatggccaaaagagtttgttattcattccgatcatgaagctttgaagcatttgaaagggcaagccaaactgaaccgtggccatgccaaatgggttgagtttatcgaaacatttccatacattgtgaaatataagaaaggtaagcaaaatgtggtcgctgatgccttgtctcgaaggaatgtgttgttgaatcaattagaggtaaaagttttgggtcttaaaattttgaaagaaatgtataatgatgatcctgaattttcagaaccatacaatcattgtaaagatggaaaaggttgggaaaaatatcatatacatgatggatttttgtttagagctaacaaactttgtgtaccgaattattcggttagattgcttatattacaggagtcacatggaggcggtctaacaagtcattttggacaaaagaagacttatgaaatgctcagtgatcatttctattggcccaagatgaggagagacgtcattagatttgtggagcgttgtgtcacctgtcacaaagctaagtcaaaattaaaccctcatggtttatatactcctttacccgctcctaaaattccttgggaagacataagcatggattttattttagggctgccgaagactcaaaaaagagagattctatttttgttgtggttgatagattttcaaaaatggctcattttattccatgcaacaagagtgacgatgcttcacatgttgctaatttgtttttcagagaaatcgtgagactacatggagtgcccaagaccatcgtatctgaccgtgatgtgaagtttgtgagctatttttggaagacattgtgggcaaagctt

SEQ ID NO: 30 - DNA, 2913 bp, Zea mays
  gene (1)..(2913)
agatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgcatggtctcattagatttggatctgcatgggttgaacatatgtattcataattaatatggtgtatacgtactagtttgctggtcttatttttttagccgcattgcttctgcctttctgcaacgcctgatccacgcgttagctagagtggattttagttccttgtttacgcggccacacctgccgcctagaaaatctgcagcgagaactctaattaaatttggatctacatgtgctagcatatatgtttgtaattaatatgatggatgaatatgtgcttcagagttgagttcctgttgatgctgtagttctgcctgaattcttgaggctgtagcttctgcctgattaaaatgcaccgtgcctatctgttaaactctagggtgtgtgatttagccggtgactcgatggtttaatatgtgtaatttcactgcttatagtaatgcaattcacctttgcagcttgaacatgcattgtcttgcattgctttgttctatacacatgcttagctattatctgatgagcatgcactgtttgatctgttgatatgcatgctcagaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtacttacggtggcaactacatcttgagcacgcatatatcttatagtgttccttttcttttcctccttggtctactgttatatgcttacctttttttggtttccttgcagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgcagatctttgtgaaaacccttactggcaagaccatcactcttgaggtggagtcttcagataccattgacaatgtcaaggccaagatccaggacaaggagggcatcccgccggaccagcagcgtcttatctttgccggcaagcagctggaggatggacgcacccttgcggattacaacattcagaaggagagcaccctccacctggtgctgcgcctcaggggaggaatgcagatcttcgtgaagacattgactggcaagaccatcaccttggaggttgagagctccgacaccattgataatgtgaaggccaagatccaggacaaagagggcatccctcctgaccagcagcggcttatcttcgccggcaagcagcttgaggacggacgcacacttgctgattacaacatacagaaggagagcaccctccacttggtgctgcgccttaggggaggcatgcagatctttgtgaagaccttgactggcaagaccataaccctggaggttgagagctctgacaccatcgacaacgtgaaggctaagatccaggacaaggaggggattcccccagaccagcagcgtctgatcttcgccggcaagcagctggaggatggtcgcacccttgcagactacaatatccagaaggagagcaccctccacctggtgctccgtcttcgcggtggttattaagccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactatcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgataccggaccatcaggttaggttagttgtgcatagaatcataaatattaatcatgttttctatgaattaagtcaaacttgaaagtctggctgaatatagtttctatgaatcatattgatata

SEQ ID NO: 31 - DNA, 1576 bp, Zea mays
  gene (1)..(1576)
ggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatgcagatctttgtgaagaccctcaccggcaagactatcaccctcgaggtggagtcttctgcaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttagggatggtatgcagatctttgtgaaaacccttactggcaagaccatcactcttgaggtggagtcttcagataccattgacaatgtcaaggccaagatccaggacaaggagggcatcccgccggaccagcagcgtcttatctttgccggcaagcagctggaggatgg

SEQ ID NO: 32 - DNA, 855 bp, Zea mays
  gene (1)..(855)
gactgccagaacctgaagtaaacatacagtaaaaagataaggtgcgacaaacaccagtaaacaaaaattagaaggcaaccaatttagtaacattaactgacatgacaaaaaacaacaatattcagcgaatagtttaaattcaaacaacatttattcatgattaagccatatgcggtcgcacgatagttttgggtaacgagaacacaactggtccatgaaaccagctcagtcacgactcacgacacaaaccatacaaatactttgaaagacagcaccatccatgggcaatggcagagacactagataacccagatacagcagcagcttcaacgactgatggcttaataaccaccgcgaagacggagcaccaggtggagggtgctctccttctggatattgtagtctgcaagggtgcgaccatcctccagctgcttgccggcgaagatcagacgctgctggtctgggggaatcccctccttgtcctggatcttagccttcacgttgtcgatggtgtcagagctctcaacctccagggttatggtcttgccagtcaaggtcttcacaaagatctgcataccgcccctcaggcggagcaccagatggagggtgctctccttctggatgttgtagtcagccaaggtgcgaccatcctccagctgcttgccggcgaagatcagccgctgctggtccggggggataccctccttgtcctggatcttggccttcacattatcaatggtgtcggagctctcaacctccaaggtgatggtcttgccagtcaatgtcttcacgaagatctgcattcctcccctgaggcgcagcaccaggtggagggtgctctccttctgaatgttg

SEQ ID NO: 33 - DNA, 10822 bp, Zea mays
  gene (1)..(10822)
taaggtgtcaggcgatccttgcattgaatgctcctgcgatacggtcggttggcgaggcgatctggccaaggttgcttcactgcgaagcctgcccgagctgggccttgggcgagttgaaggtgcgtccgttgcttgaggaggcccttgggcgaggcgtgaatccgcctgggtctactgttcctgcccgaggctcggctcgggcgaggcaagatcgtgtcccttgagtggacgaagctttgacctgtattgcgcccatcaagcctttgcggcttgtgctgatggtggttaccagccgagtttaagagtcttgggggtacccctaattatggtccccgacaggtcctatcatacgctgaggcctgagccatgcgtcagtggccccttccaacattaggggatagtgtttaggagtccaaaaaccggagagtactaaataagctaaaatctcatctttatttaaatttgagtaataaggaaattttaatccatctaattctctccgttttttggctcccaaactagcactataggatattgtttcctaaaatctgccaaacaagtgaaacaactcccttaaaaaactaaaaaaacaagcctttttcaataatccatcatgaagatcatataacgatctaacacgtcattatatttcatgtttttcaaaaaggaaaatgtcgaggtgcaatgattgggcgggttctagatcactcagggctagtttggtgagtcacaaaaccggagatgattggatgagctaaaatcactttcttattcaattttaaataagaataaaattttatcatctccaatccctttccagtattttagctcccagactagtcatcgtagaagaaaaatgaaccggtcagcttcagataaagaatgccatgggtttcagaatatgttcacatcgatggaaggattgaaggaagatgtccctgaaacgaatctgtatccatattgtactgcatccagctaagcgagacggtgacacattgtccactggccttatccaaaacgcatcatgcctaacgaggcacaatcatcttgtttgtacttgtttactcacaagaacagcaagtgaggggcccttgtgatttctttggcgatggcatcaagaaaatgcggttagaaattgcaccaagctgtgatcgattgactcaatataaaccataataaatcgtacagacttttttttttgaagaatcaggaggggggcctactgagaattttattgaagatgagaaaagaaaatgttacaacttaacctttttacaaaagttaatccgagagatctaaataataagtttaaatgcaatggattagaaagaactactcctatgtctgccacagactcagccaattcgggatggagatgtcaaagttcccacgcgctctgtgcatgatcaaccgcaactccttacataattcttgtgtacagtgatgaatcgaaggatctttgtttgaaaacagccactcatttcggctttttaagatgctctatgtcatgagaataataatctccatagagaaggggacgttaagctggtgtttaaggttcgctgatgtctcctcaggattagtaattctggagggttatgccaattgagttccagcaagctttcgcaaaattgcatctgaggaacagatgatatagggtctcctctctttgccataaacagttctcgcaagaataagattccagttccatgtttttccttctcagcatatctctggtatttagtctatttttaagccacaaccaatagaaaactctatgcttaggctgacatttgcttttccataagtgcctgtagatagggtgaacctgcgtctggcccataaaatgtctgtaagctttttgagaagagtagttgtcaaagccccaaatgtatcgccaacggtcgtgagcattactgaggacaatttgctcccaaaccacctgcaactccaggtattgatcatatgcttgttcagagataggcaaatgaaaaaaaccagcgaactgatcctactctttagcttcttcaatagtcaattttgtgtttttgacaaaagagaataattctgggaatttttgccttgggatgttctgactccactgatcctcccagaacgaaattgatctgctgttgccaatgactgggagtgccagtcccttaaagttgggaaggagcttgatcatgctcttccaccagaaaaaaccaatgtttctatggcctgtgagtccacgagacaaatagtatttatcccaaacgagatgcacccagggtaagtcgttgttattgaagaatttatgcaaaaaattgatcatgagagcctcattctgggtttcaaggcgaaacacccccagcccgccattcacttttctctgagtaaccgaatttcaagcaatcagaggcggcttcttggaactaatgtcattccctctccacagacaatgtttcctgaacatgtctatttgcttaatgatggttttaggtatcttgagcatgcacataaagaaggttggcaaggctgagaagactgaatttaccaactccaagcgtccagcttgagataaaaaatttgaagagcaagataatctcttctcagtcctttgaataagaggcagaaagtgttcctttctgggtttcgcaaggcctagaggcaaaccaagataggtgaatggtatttctccaatctggcaattgagagttcgagagaggatctccatcttttcagaaggcacgtttatagagtacatattttatttgttataattaaccttaaggccagtagaagaagcaaaagagttgagaattgccttgaggaagaaaagttgcttaggacaggcctccataatcaaaagagtgtcatctgcatactgaacaatcgagaaatcatggtcaccaatatccggtaaagggagcttaagaagattccacagtcttgccttattaataatgctctgaagaaggtcatcgtacagactagttagtgattgactaataaatgaaaaatcatttgaaaaaatggggttaccaaagtagcaaaaacttgtcatgattgtgactacaaactaaacacacatttaaatcaattaaactgcctaaactttagacatggtgaattgtgcattgtgatgcatcgaactaaatagactgtaaggcaccggtgtcattttagcttaggctatctccagcaacgtcccctaaatttcatcccctaaaagaatattctctgtcctttacagcactctctaaaagattttgtactctatatcttcttcatctccagcaatatcccctaaatttcatcctctatatcaacagtgctactagatttgacattctatattatttttttaccgctcgtcagcacgtgcacagaaatcagcacactatatagagcaccgccgtacatcctctatacatagcgcatgcatgtcatcctctaaattttagagtaccttttagagtcccttgttggagggatagaggatctgacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgcagatctttgtgaaaacccttactggcaagaccatcactcttgaggtggagtcttcagataccattgacaatgtcaaggccaagatccaggacaaggagggcatcccgccggaccagcagcgtcttatctttgccggcaagcagctggaggatggacgcacccttgcggattacaacattcagaaggagagcaccctccacctggtgctgcgcctcaggggaggaatgcagatcttcgtgaagacattgactggcaagaccatcaccttggaggttgagagctccgacaccattgataatgtgaaggccaagatccaggacaaggagggtatccccccggaccagcagcggctgatcttcgccggcaagcagctggaggatggtcgcaccttggctgactacaacatccagaaggagagcaccctccatctggtgctccgcctgaggggcggtatgcagatctttgtgaagaccttgactggcaagaccataaccctggaggttgagagctctgacaccatcgacaacgtgaaggctaagatccaggacaaggaggggattcccccagaccagcagcgtctgatcttcgccggcaagcagctggaggatggtcgcacccttgcagactacaatatccagaaggagagcaccctccacctggtgctccgtcttcgcggtggttattaagccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccatagcaatttataacatagggaggtcacaaaacatgtgtttggatcatgtgcaagaaaaacaagaatataggaatgcaaggtacaaaacgaaagaaaacatgagattggatctcatgtttatttttctttaaaaatattatgaaggatgtcatttcatacaaattttgaagggactggtaggatctaattctttgtttcaataggaaaaccttttataggaactgaatcctttgttttcttccatttcaaaggagacctgagtttgattactagttgatcgatcaagctttgtttgatctgttaaatatcagtaaatcacaatgtgtccggagaaaataatttctttacatcctttaattcttattgtactgatcctatggagagcaagttctgaaaatgtcaattaatattgctttgacttttgagttttgttaggctagtgctcatattaccttgcactcttgcaggttcgggttgtttccagtttcttgttggatgtttactctatattgactatagctagagtgttcatatacaccaatgtcggaataattttaaactagaaaacaggtgcggcgatatggagacgattagtgggagtgaattagactatgttcaacggttcgcccttggctccccctcccctaccactgtagctgttttaggggttacagtgcgcccctattctcttcaccggcttcctcctcctcctcctctcccctcccgattccttctctctcccgctaaatggatggacacgctactgcgccggatttctccccagccggttccttcggccacgcgaccgcgcgctcggaaaactccacggacagcgaaggaggcgaaccaagggcgacgtattcgccgccggagaaggtaagtgtcgatccgccgtgtcccgcgattcgtttgtcttgctccgagcggcgaacagcagtgggggtcgtcctcgcggatccgtcttcaagctttcgcggatccgccttcaagcttcgcggatcccacacgaaacctccgagttctctcgccaattcgatccgcctcaccgccgccgcccgtccgccggtcggccttgactgctccgtcgcacgtggcggttcgcagcacggaatctaccttgtgttgacagatccggggaaacccttgttcccggtcgttccggctcgaatcttctgcggactggcaatgtaagcgttctccattggagggcgacgatctacggggcggttgttggcagggttgcgggaatggagcacgtgttcggagggaagtttaagcttgggaagaagatcgggagcggatctttcggcgagctctatctcggttagcgtctcgccgggttcttcattgattctgtcacgcgtctctgcagattcctacgcgtcgttgtttttggctgcaggcgtcaacatacacagcggcgaggaggtggctatcaagttgttattagataatctgatactgttcgtgcaccatttttctctgtcgtggagttatatgcctggcattcggcatgagtttgttccatatgcaaacatatcatggtcaaccattgctagcaacggtttcgtgaagaatttgtgtgtagattatgggatgacagaaaatggatgatgttctgcatgtaattgctttaaaaaagactggcatggtcccgagctatatttttacatgagtaataacaagattttcaaaccttttcttggttgtccatgcgaattgacctgcgcatccagttctaattccaatcatggttctgttacctttcattagtgtgactgtataacagttcctttttttaaagaaagtaacaaggcatattttcagatcatatgaagaaagcacttgcagaatgttgatatcttgtggtctatgataacagaatttaaagttttacattatatcctgtatatatgtcatgatcatggattgactgaagcaaaaaaagaagtgctgagaatgtgaggttatatttttctatttgtaatggctttctagcatgaacatatactggtttttgaacatttgcttaattgtttgagaacagttacttgtgtactaagttacagccgcgcactgtttatagagcaaataaaaataaatcaaatattggatggtagttgagttagttgatgatgaaagtataaaaaaaatggtgtggtggagtatagatgttt

SEQ ID NO: 34 - DNA, 8661 bp, Artificial Sequence
  Nucleotide sequence of the ZmHSP70 assembly construct 15902
  promoter (22)..(3026)
  exon (3033)..(3647)
  Intron (3648)..(4056)
  exon (4057)..(5253)
  terminator (5260)..(6253)
tcgagcggaccgatccgaccaaataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaaggcaatggaacaaggcgttagaagtttcatccaacttttttgctggtcttaattgcaacttctcctagaactctgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagaactcgtatggtgtttgatcgagtttcttcatcaatgtagaccttgtttagatactctcatatttacttcaatacatgtgtattgaggtgaactagagtgtaaattagtttaaattacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattctagaacaccacagcccacgcgctgacgacgagccctttgttccctataaaagccactgcccggctcagtctctcgccctctcgaaaccctagtcccctgctccattctcagccgccgccaatcccttcccgtgctccgcaaccgctgagtgagaagaagagatcgccggcaagggcgatcgcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatccggccaagaaccaggtcgccatcaaccccatcaacaccgtctttggtgagtacactccaccatttaggctcttactcctttcctagctcggatacgttttgtttaccgtgactagcggttttgtctgacccatacgacccatctacgttactgcttgatttgatatgtttaagtttctgtcgtaaaagtagctcagatccgatctagtttggctatgtttttgtctagatcggttggatctgaaggcgactgtgatctgtagtagttccgtagttatttttcctctggctgggtttagatctgttattgtttgtcatggtagctttagatctatttgttttttatcacctatttggtatataatactggtccgaaggctctgcagtactatttgtcaactcttggcagattgatgatgaaacaattaccccaagcgctttattccactgatgccagtgatggaaaactatgttatcatagtttttgtggttttcaatctgaaactgcagatcaagagtttttttaggtttccttcgattttgtgtttggtttttcttcttccagccatgacaaaatgaaaaccattagttttatttggttaagtaatgggataagtgatgatatttgtatccacacgagatatctgtatttactattatgccaacattatgcatctccatctgatctctcattatcttatcatattgctttagctacaactattggctccctagttttagattgtaccttatatgattggtggttggcacctctgcacatcaatcattgctttgattgccaacgtttaaaaatgttgtactgctatttatttgctcttattttttatcatgcatgtggttgagatttacttgagtagaacgttcacgttgtagtacaatttttactggagaagtgatgaagtcataacataggaaatatctgcattcactgtgatgatcacatcatgcactaccatctgatctcctacatttcaattttattgcaaacttttgccagttttatagtaacttgtaattcggcagtagttctgtgaagtctatagtatttgttgttttttatgtgcaatccgtgatgcaagacaatttcctgaaccactgtgattagtacagcaaaaatcaccatctttcgactgagattgcactgccagtttgagttttattgcatgcaaagtgtttctgtgtgtaatttgttgcagtcaatgccatttggtatctgactcgcagtcatttttcgtgattgtgtgtctcgaaacatggcagaaaacaaaggggaatggatcttgcgacactggttgaccatttatgagcttccagttactatatgcccatttacattatctgtttgggcaagtgattatgactgaaaaaactgacgtctgttttttcttagctagcaagttgtattttttttgaaatcagtctgattattggagtttgttgattgacctttatgctattggtatcttgactcatgtcagttttttattagttaggtatacttggttacataagcagatatcatttgattgatcaaagttttgtatttgttaacagaagtgttgttgtgttacatttcaaattgtatggtattagaatgcatttctgacatgattgggttcatatgcagatcccaagcgtaaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgcggtttgttgtcagtcttgagtgtgctgcagttgctggctggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaccttttgccagttaggaggccattctcatttgattgtttaccacaatttttaggctgtcatgttatgtggcatttaatgaaattgataaactcccacccagaatagctagcagcttttgttgggtcctggtttttcttgtcctcgaagagttttgggagcaaaacggtttctttatatttttttttcctcaatacctcattatgtccgaaatctttctccgctagtatctgtactctgtgcagagatttttcttaaattctttatacctactaccttaataaaacactctcgtccataaatgttggtcatttttgttcttactatgttcttatgtcagaaatctttctcccccagtttttcaactctgtgcagagctttttcttaaattcattatacctactacctctataaaatactctcgtccataaatgttggccatttttatttttaaggagtcaaacatttttaactttgatataagaaattttaatatttatagtataaaatttatatcagatctttgaatctccttttataatgttacaataaaattattttataattttagttaaaattaagaaagtttaattgacacgaacaacatgtcgacaaacatttatcgatgaaggaagtaccatctctcttacattaccatttttaacaggacttataaaataccatctcttttacacgactaacatataaagcagggacccgggcccatcgatgatatcagatctggttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttaacctggcttatcgaaattaatacgactcactatagggagaccggcc

SEQ ID NO: 35 - DNA, 9949 bp, Artificial Sequence
  Nucleotide sequence of the ZmUbi158 assembly construct 17222
  promoter (16)..(4071)
  exon (4072)..(4686)
  Intron (4687)..(5095)
  exon (5096)..(6292)
  terminator (6299)..(7298)
tcgtcgacgggaccctggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattacggaccgtcgacaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaat

SEQ ID NO: 36 - DNA, 8983 bp, Artificial Sequence
  Nucleotide sequence of the ZmUbi361 assembly construct 17267
  promoter (15)..(3103)
  exon (3104)..(3718)
  Intron (3719)..(4127)
  exon (4128)..(5324)
  terminator (5331)..(6331)
cgtcgacgggacccgacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatccagagtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccatcagtcgttgaagctgctgctgtatctgggttatctagtgtctctgccattgcccaaggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccatacggaccgtcgacaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaatt

SEQ ID NO: 37 - DNA, 3929 bp, Artificial Sequence
  Nucleotide sequence of pCR2.1
  promoter (887)..(1024)
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctcggatccactagtaacggccgccagtgtgctggaattcggcttaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 38 - DNA, 4700 bp, Artificial Sequence
  Nucleotide sequence of pNOV6901
  exon (93)..(707)
  Intron (708)..(1116)
  exon (1117)..(2313)
tggcttatcgaaattaatacgactcactatagggagaccggcctcgagcagctgaagcttgcatgcctgcaggtcgactctagaggatccccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgcactagtcccgggcccatcgatgatatcagatctggttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttaacc

SEQ ID NO: 39 - DNA, 1104 bp, Zea mays
  5'clip (1)..(1104)
ataacatatgtatccgtcacttatccgtccaaataaatatctggtcgctgtatccgtatctatcccgtttctaactatttgtatatgatcccgaatccgattgaaatacattagggtaggatacaagatgagcccctatccgtctgtatacgtcccgtttttacccatactcgtcaaactttttaggacttgtttgattgtgtccgaatcaaaggggattgaaggagattaaatccctccctaataaaaaataaatagaaaaagatttaatcttcttcaattcaaaggcaatggaacaaggcgttagaagtttcatccaacttttttgctggtcttaattgcaacttctcctagaactctgttgactccatcttccataactccattaagctcagagctagaacctacatttatgcacaatttttttatttcaaaaagaacctacgtctattccaaacgatgtgataaaaaatgcaataattttgtagggctagtttagaaactcaaatcccctatataatcaaaggagatttaagtttctcgtagagcttatttggatgcatgggattgtaagaactcgtatggtgtttgatcgagtttcttcatcaatgtagaccttgtttagatactctcatatttacttcaatacatgtgtattgaggtgaactagagtgtaaattagtttaaattacactttaatccactttattacacgtggattggggtgaatattgagtatcgaaacaatgactcatcagggaggcttgtctctgtgggctggttctaagcgtaagcgggccggccagcacttatggtatatgacttgggctgagatctggtcacaacccatccctccgtcaaagattccttttactcacgtgaaagcaaccagaaaggaaaaaaaaggccgtttaaatagccgaaaggcgcccgtggaaaagacgccgccatgcgccttcgttcacacgatcgcgtgccaacggctcagatgtccccacgacgcgcccaggaacattctagaacaccacagcccacgcgctgacgacgagccctttgttccctataaaagccactgcccggctcagtctctcgccctctcgaaac

SEQ ID NO: 40 - DNA, 304 bp, Zea mays
  5'UTR (1)..(304)
cctagtcccctgctccattctcagccgccgccaatcccttcccgtgctccgcaaccgctgagtgagaagaagagatcgccggcaagggcgatcgcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatccggccaagaaccaggtcgccatcaaccccatcaacaccgtctttgatcccaagcgtaaacc

SEQ ID NO: 41 - DNA, 1602 bp, Zea mays
  Intron (1)..(1602)
gtgagtacactccaccatttaggctcttactcctttcctagctcggatacgttttgtttaccgtgactagcggttttgtctgacccatacgacccatctacgttactgcttgatttgatatgtttaagtttctgtcgtaaaagtagctcagatccgatctagtttggctatgtttttgtctagatcggttggatctgaaggcgactgtgatctgtagtagttccgtagttatttttcctctggctgggtttagatctgttattgtttgtcatggtagctttagatctatttgttttttatcacctatttggtatataatactggtccgaaggctctgcagtactatttgtcaactcttggcagattgatgatgaaacaattaccccaagcgctttattccactgatgccagtgatggaaaactatgttatcatagtttttgtggttttcaatctgaaactgcagatcaagagtttttttaggtttccttcgattttgtgtttggtttttcttcttccagccatgacaaaatgaaaaccattagttttatttggttaagtaatgggataagtgatgatatttgtatccacacgagatatctgtatttactattatgccaacattatgcatctccatctgatctctcattatcttatcatattgctttagctacaactattggctccctagttttagattgtaccttatatgattggtggttggcacctctgcacatcaatcattgctttgattgccaacgtttaaaaatgttgtactgctatttatttgctcttattttttatcatgcatgtggttgagatttacttgagtagaacgttcacgttgtagtacaatttttactggagaagtgatgaagtcataacataggaaatatctgcattcactgtgatgatcacatcatgcactaccatctgatctcctacatttcaattttattgcaaacttttgccagttttatagtaacttgtaattcggcagtagttctgtgaagtctatagtatttgttgttttttatgtgcaatccgtgatgcaagacaatttcctgaaccactgtgattagtacagcaaaaatcaccatctttcgactgagattgcactgccagtttgagttttattgcatgcaaagtgtttctgtgtgtaatttgttgcagtcaatgccatttggtatctgactcgcagtcatttttcgtgattgtgtgtctcgaaacatggcagaaaacaaaggggaatggatcttgcgacactggttgaccatttatgagcttccagttactatatgcccatttacattatctgtttgggcaagtgattatgactgaaaaaactgacgtctgttttttcttagctagcaagttgtattttttttgaaatcagtctgattattggagtttgttgattgacctttatgctattggtatcttgactcatgtcagttttttattagttaggtatacttggttacataagcagatatcatttgattgatcaaagttttgtatttgttaacagaagtgttgttgtgttacatttcaaattgtatggtattagaatgcatttctgacatgattgggttcatatgcag

SEQ ID NO: 42 - DNA, 459 bp, Zea mays
  3'UTR (1)..(459)
gcggtttgttgtcagtcttgagtgtgctgcagttgctggctggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaccttttgccagttaggaggccattctcatttgattgtttaccacaatttttaggctgtcatgttatgtggcatttaatgaaattgataaactcccacccagaatagctagcagcttttgttgggtcctggtttttcttgtcctcgaagagttttgggagcaaaacggtttctttat

SEQ ID NO: 43 - DNA, 535 bp, Zea mays
  3'clip (1)..(535)
atttttttttcctcaatacctcattatgtccgaaatctttctccgctagtatctgtactctgtgcagagatttttcttaaattctttatacctactaccttaataaaacactctcgtccataaatgttggtcatttttgttcttactatgttcttatgtcagaaatctttctcccccagtttttcaactctgtgcagagctttttcttaaattcattatacctactacctctataaaatactctcgtccataaatgttggccatttttatttttaaggagtcaaacatttttaactttgatataagaaattttaatatttatagtataaaatttatatcagatctttgaatctccttttataatgttacaataaaattattttataattttagttaaaattaagaaagtttaattgacacgaacaacatgtcgacaaacatttatcgatgaaggaagtaccatctctcttacattaccatttttaacaggacttataaaataccatctcttttacacgactaacatataaagcag

SEQ ID NO: 44 - DNA, 994 bp, Zea mays
  terminator (1)..(994)
gcggtttgttgtcagtcttgagtgtgctgcagttgctggctggcccagttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcggtatttgtttctgcatactgctggctcgtattttgtttttgagcttgcgattctttgttaatttcaaccttttgccagttaggaggccattctcatttgattgtttaccacaatttttaggctgtcatgttatgtggcatttaatgaaattgataaactcccacccagaatagctagcagcttttgttgggtcctggtttttcttgtcctcgaagagttttgggagcaaaacggtttctttatatttttttttcctcaatacctcattatgtccgaaatctttctccgctagtatctgtactctgtgcagagatttttcttaaattctttatacctactaccttaataaaacactctcgtccataaatgttggtcatttttgttcttactatgttcttatgtcagaaatctttctcccccagtttttcaactctgtgcagagctttttcttaaattcattatacctactacctctataaaatactctcgtccataaatgttggccatttttatttttaaggagtcaaacatttttaactttgatataagaaattttaatatttatagtataaaatttatatcagatctttgaatctccttttataatgttacaataaaattattttataattttagttaaaattaagaaagtttaattgacacgaacaacatgtcgacaaacatttatcgatgaaggaagtaccatctctcttacattaccatttttaacaggacttataaaataccatctcttttacacgactaacatataaagcag

SEQ ID NO: 45 - DNA, 1506 bp, Zea mays
  5'clip (1)..(1506)
ggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttcccca

SEQ ID NO: 46 - DNA, 163 bp, Zea mays
  5'UTR (1)..(163)
acctcatcttctctccttttgctctgaacgcacacaccgcccggtctccgatctccgatccccgatcccctcgtcgatcctagatccagatcttcgtatttttacaacaattaccaacaacaacaaacaacaaacaacattacaattactatttacataaacc

SEQ ID NO: 47 - DNA, 143 bp, Tobacco etch virus
  enhancer (1)..(143)
aaataacaaatctcaacacaacatatacaaaacaaacgaatctcaagcaatcaagcattctacttctattgcagcaatttaaatcatttcttttaaagcaaaagcaattttctgaaaattttcaccatttacgaacgatagca

SEQ ID NO: 48 - DNA, 2386 bp, Zea mays
  Intron (1)..(2386)
gtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcag

SEQ ID NO: 49 - DNA, 341 bp, Zea mays
  3'UTR (1)..(341)
gccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccg

SEQ ID NO: 50 - DNA, 660 bp, Zea mays
  3'clip (1)..(660)
tttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattac

SEQ ID NO: 51 - DNA, 1501 bp, Zea mays
  5'clip (1)..(1501)
gacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagc

SEQ ID NO: 52 - DNA, 260 bp, Zea mays
  5'UTR (1)..(260)
cgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaagatccagagtatttttacaacaattaccaacaacaacaaacaacaaacaacattacaattactatttacataaacc

SEQ ID NO: 53 - DNA, 1329 bp, Zea mays
  Intron (1)..(1329)
gtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcag

SEQ ID NO: 54 - DNA, 1001 bp, Zea mays
  terminator (1)..(1001)
gccatcagtcgttgaagctgctgctgtatctgggttatctagtgtctctgccattgcccaaggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccata

SEQ ID NO: 55 - DNA, 1000 bp, Zea mays
  terminator (1)..(1000)
gccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaatta

SEQ ID NO: 56 - DNA, 65 bp, Zea mays
  3'UTR (1)..(65)
gccatcagtcgttgaagctgctgctgtatctgggttatctagtgtctctgccattgcccaaggat

SEQ ID NO: 57 - DNA, 936 bp, Zea mays
  3'clip (1)..(936)
ggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccata

SEQ ID NO: 58 - DNA, 3956 bp, Artificial Sequence
  Nucleotide sequence of pCR4-TOPO
  promoter (1764)..(1862)
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcagaattaaccctcactaaagggactagtcctgcaggtttaaacgaattcgcccttaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 59 - DNA, 8087 bp, Artificial Sequence
  Nucleotide sequence of vector 17680
  promoter (370)..(769)
  terminator (2528)..(2780)
attaattcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgtacgtagcactagtgaattccggaccgaagcttgcatgcctgcaggtcgactctagaggatcctggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagtaggatccacatggagttatctcttctccgtccgacgactcaatcgcttcttccgtcgttttcgaagcccaatctccgattaaatgtttataagcctcttagactccgttgttcagtggccggtggaccaaccgtcggatcttcaaaaatcgaaggcggaggaggcaccaccatcacgacggattgtgtgattgtcggcggaggtattagtggtctttgcatcgctcaggcgcttgctactaagcatcctgatgctgctccgaatttaattgtgaccgaggctaaggatcgtgttggaggcaacattatcactcgtgaagagaatggttttctctgggaagaaggtcccaatagttttcaaccgtctgatcctatgctcactatggtggtagatagtggtttgaaggatgatttggtgttgggagatcctactgcgccaaggtttgtgttgtggaatgggaaattgaggccggttccatcgaagctaacagacttaccgttctttgatttgatgagtattggtgggaagattagagctggttttggtgcacttggcattcgaccgtcacctccaggtcgtgaagaatctgtggaggagtttgtacggcgtaacctcggtgatgaggtttttgagcgcctgattgaaccgttttgttcaggtgtttatgctggtgatccttcaaaactgagcatgaaagcagcgtttgggaaggtttggaaactagagcaaaatggtggaagcataataggtggtacttttaaggcaattcaggagaggaaaaacgctcccaaggcagaacgagacccgcgcctgccaaaaccacagggccaaacagttggttctttcaggaagggacttcgaatgttgccagaagcaatatctgcaagattaggtagcaaagttaagttgtcttggaagctcttaggtatcactaagctggagagcggaggatacaacttaacatatgagactccagatggtttagtttccgtgcagagcaaaagtgttgtaatgacggtgccatctcatgttgcaagcggtctcttgcgccctctttctgaatctgctgcaaatgcactctcaaaactatattacccaccagttgcagcagtatctatctcgtacccgaaagaagcaatccgaacagaatgtttgatagatggtgaactaaagggttttgggcaattgcatccacgcacgcaaggagttgaaacattaggaactatctacagctcctcactctttccaaatcgcgcaccgcccggaagaattttgctgttgaacatgattggcgggtctacaaacaccggaattctgtccaagtctgaaggtgagttagtggaagcagttgacagagatttgaggaaaatgctaattaagcctaattcgaccgatccacttaaattaggagttagggtatggcctcaagccattcctcagtttctagttggtcactttgatatccttgacacggctaaatcatctctaacgtcttcgggctacgaagggctatttttgggtggcaattacgtcgctggtgtagccttaggccggtgtgtagaaggcgcatatgaaaccgcgattgaggtcaacaacttcatgtcacggtacgcttacaagtaaatgtaaaacattaaatctcccagcttgcgtgagttttattaaatattttgagatatcaaacttcaatttcattttgactaaattactcacactggcggccgccaccgcggtggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccgga

SEQ ID NO: 60 - DNA, 15857 bp, Artificial Sequence
  Nucleotide sequence of vector 18271
  promoter (811)..(4864)
  exon (4867)..(5481)
  Intron (5482)..(5890)
  exon (5891)..(7087)
  terminator (7094)..(8093)
attcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccagctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttcggtaccggaccctggaaaaccaaaacaacgaataagcaaactgcaggaaaagtatgcagtggaaaccaacccagattcggacgataggaaagtatcatgtgaatgatttgccaggaaaaggagaggggtaaaaaggggcgaagatttagaagatctaaagcacaagaaccagagattagattgaacaatagggaacatggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaaggtataaagaatacattaacattcagtgaaacagcatgctgtcttcttctttttttatgcacaacagagcatacatatataccttcccaggctgaggacttggcggaggagagccgcggagaggatggcggtgcagacggtctggacgggcccgaagacggagacgaacagcgggcccttcctgcccaggcaccacgcttggaacgccatgcacgcgccaaccgcggccccgccgaggacgacgatccccgcgacaagcgtggcgtcgatcctgggcgaccccatgccgaggaacctcccttccaggacgagccgcaggacggcggtgagagaggcacccgtcgcggaggtggcgcagcacatggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggaaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctcccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccaaggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattacggaccgaagcttgcatgcctgcaggtcgactctagaggatcctggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagtaggatccacatggagttatctcttctccgtccgacgactcaatcgcttcttccgtcgttttcgaagcccaatctccgattaaatgtttataagcctcttagactccgttgttcagtggccggtggaccaaccgtcggatcttcaaaaatcgaaggcggaggaggcaccaccatcacgacggattgtgtgattgtcggcggaggtattagtggtctttgcatcgctcaggcgcttgctactaagcatcctgatgctgctccgaatttaattgtgaccgaggctaaggatcgtgttggaggcaacattatcactcgtgaagagaatggttttctctgggaagaaggtcccaatagttttcaaccgtctgatcctatgctcactatggtggtagatagtggtttgaaggatgatttggtgttgggagatcctactgcgccaaggtttgtgttgtggaatgggaaattgaggccggttccatcgaagctaacagacttaccgttctttgatttgatgagtattggtgggaagattagagctggttttggtgcacttggcattcgaccgtcacctccaggtcgtgaagaatctgtggaggagtttgtacggcgtaacctcggtgatgaggtttttgagcgcctgattgaaccgttttgttcaggtgtttatgctggtgatccttcaaaactgagcatgaaagcagcgtttgggaaggtttggaaactagagcaaaatggtggaagcataataggtggtacttttaaggcaattcaggagaggaaaaacgctcccaaggcagaacgagacccgcgcctgccaaaaccacagggccaaacagttggttctttcaggaagggacttcgaatgttgccagaagcaatatctgcaagattaggtagcaaagttaagttgtcttggaagctcttaggtatcactaagctggagagcggaggatacaacttaacatatgagactccagatggtttagtttccgtgcagagcaaaagtgttgtaatgacggtgccatctcatgttgcaagcggtctcttgcgccctctttctgaatctgctgcaaatgcactctcaaaactatattacccaccagttgcagcagtatctatctcgtacccgaaagaagcaatccgaacagaatgtttgatagatggtgaactaaagggttttgggcaattgcatccacgcacgcaaggagttgaaacattaggaactatctacagctcctcactctttccaaatcgcgcaccgcccggaagaattttgctgttgaacatgattggcgggtctacaaacaccggaattctgtccaagtctgaaggtgagttagtggaagcagttgacagagatttgaggaaaatgctaattaagcctaattcgaccgatccacttaaattaggagttagggtatggcctcaagccattcctcagtttctagttggtcactttgatatccttgacacggctaaatcatctctaacgtcttcgggctacgaagggctatttttgggtggcaattacgtcgctggtgtagccttaggccggtgtgtagaaggcgcatatgaaaccgcgattgaggtcaacaacttcatgtcacggtacgcttacaagtaaatgtaaaacattaaatctcccagcttgcgtgagttttattaaatattttgagatatcaaacttcaatttcattttgactaaattactcacactggcggccgccaccgcggtggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 61 - DNA, 14891 bp, Artificial Sequence
  Nucleotide sequence of vector 18272
  promoter (811)..(3899)
  exon (3900)..(4514)
  Intron (4515)..(4923)
  exon (4924)..(6120)
  terminator (6127)..(7127)
attcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccagctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttcggtaccggacccgacaaacctctatatgtagagtacaggagcttttacaggaccctgctggagccagccttagggggaaaacttccaggcggtaggtcacatacatcagtgaggtaggagaaatgtgccaaccacgtggtgtcgaccaatctacattctaatctatatcattatataatttatcagtttaaactttacaaaatctatctaaacaaatcacatctacacccataacattcgttaaatctaacacagtatcaaaactagcggttcaaatcgatggataacatgttctcccatatccattcaaatctgatagataatattatttagatcatgtattctctctcccctctccctcgacgcctcctcctgccccgtgtccctgacctgtctccctcacttatgatgttgtctctatcatcaatcgctccttttatattgtgatcactgtccacccctattcctactcgggattagggatggcaatggaaaatttctcatcgaggaatagctcttcatacccatcccacgacgcagaaatttcctcgcgggaatacccacgaacgtttacagaagacatttcttccccatccatattccccacgggcataaatttccgacggagatcaacgtccctatttacattataattaggaaatgcatcctttgttattaataaaaacactttcacttatatatattgttagatgtaagaaatcattatgggtatattaaaataaacatatttgtacaatgattgatctcttacccaaataattatttgtttttattattagctagtatacgaaaacatcaccacgtacaggtttgacggattcccacagaaacagggatgaaaaatacttctacatccctgtcccgtttacccatctgagaaagcgggaaatcgggcataggatccattgccaaagatcgtagggctataacctaagcgttgcaacgaagcgaagcagacggtggagacgttgacgcaaagcaatgaacttgaacggcatctctctcgctggccctggccttctcgaaggctctgcgtgggtccttgcgcagttgcgccgcagcgggctggcagcatccggaaattgcgtcttgcgtggcggagcagacactaaggtactattttacgttctatttagttggactgtggcggtaaactatgaaaaaaactattgcagactatgagctattaaaaagctaaaaattatttagtgtaaaccactaaaaaccattaaaaattctttgatatatattttcacagttttataaaaaatccactaaaaacaggtcaaataagctttcaattttacactacgaaaaagtcagcttttaaaaaaaactgcttaaatccagtcctttagtttaatttttatcttttaggaaacaaaagccaaaactaaaaccaaaccaaacctacctttaaaaccgatctaataggaacgcggtgtttggaacaactagatattaattttagaggttagaccgccacgaaagcgtcactgcacacggcattcccctcccctagcgttatcgtcgcaccataaataaccatcctctcctcgcctttccccacatctcatcttcgtctgtgttcttgggcgtacgcggacacagccccgatccgaatcgtcgtccttgcgagcctcgccgatcccccactcccctcccctcgcttcaaggtaactgcgatcatccatcctcccgcttccactctcccttcacctcctctgcttgctaggtatacgaacatacgatttattacgggttatatgggggcttcgattcccagatctggcgatctattatcgtagctccgagtcctcgatctagtaattgtgggatatgcttgtaagaggctctgagatgggttgggttgggttgggtcgctgtgacgattccaacagcctcgtttcttagggttggatcttctcgtggtttcctttttaattaaataagtacctgatgcagaatggtgcgtcctattagatggaaccttgatcttgatgcatctaaccttgatcttgttcgctgtgatgattccaacaggctcgtttcttaggcctgttcgtctggttcgtcagatcagtttcgttgcttttggcctcgttgtaaggtccatccagatcggagtagaatcgaatgatttattatacggtagctgctggtctcattagatttggatctgcatgggttgaacatatgtattcataattaatatggtgtatacgtactagtttgctggtcttatttttttagcctgattgcttctgcctttctggcaacgcctgatccacgcgttagctagagtggattttagttccttgtttacgcggccacacctgccgcctagaaaagctgcagcgagaactctaattaaatttggatctacatgtgctagcatatatgtttgtaattaatatgatggatgaatatgtgcttcagagttgagttcctgttgatgctgtagttctgcctgaattgttgaggctgtagcttctgcctgattaaaatgcaccgtgcctatctgttaaactctagggtgtgtgatttagccggtgacggtggtttaatatgtgtaatttcactgcttatagtaatgcaattcacctttgcttgaacatgcattgtcttgttgctttgttctatacacatgcttagctattatctgatgagcatgcactgttttgttctgtttgatatgcatgctcagaaatatgtagatgtgtggctcctgctcggttgttctttatcatccacctgttgaacatgcatgttcttgtcgcttatctttattatatattaccttcgttctcgaatatttgtcgcccgctagttcatttttgaactaaaccgtgacaaataaaatagaacgtagggagtggcatcatgctgctactgtaccttacggtggcaactacatcttgagcacgcatatatcttatagtgttccttttcttttcctccttggtctactgttatatgcttacctttttttggtttccttgcagatccagagtatttttacaacaattaccaacaacaacaaacaacaaacaacattacaattactatttacataaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctcgccatcagtcgttgaagctgctgctgtatctgggttatctagtgtctctgccattgcccaaggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaactattcgctgaatattgttgttttttgtcatgtcagttaatgttactaaattggttgccttctaatttttgtttactggtgtttgtcgcaccttatctttttactgtatgtttacttcaggttctggcagtctcattttttgtgactagttaaaacttacagctaaaaaaatgcagtttttcattttcatttgaagtttgattagagctattgatacccggaccatcaggttaggttagttgtgcatagaatcataaatattaatcatgttttctatgaattaagtcaaacttgaaagtctggctgaatatagtttctatgaatcatattgatatacatgtttgattatttgttttgctattagctatttactttggtgaatctatataggcttatgcagaacctttttttttgttctatatatccatatcctagtactcagtagctctatgttttctggagactagtggcttgctttttcgtatgtctaattttttgcttgaccattgcaaaacaaaaattacctagtgtaatctctttttataataatcttgtaatgcgtctacctataggtcaaagtaggttttgtttggaacccttagagctaactgttagctagttgataaattattagctgagttaagctagctaatgaactagttttgatattagctgaggatgtttgaaacctaataattattttttattagctaactatactaaattttagtagagagattccaaacaggagttaacatgggatcagattggctatgcgtttgcaatcccatacggaccgaagcttgcatgcctgcaggtcgactctagaggatcctggcagacaaagtggcagacatactgtcccacaaatgaagatggaatctgtaaaagaaaacgcgtgaaataatgcgtctgacaaaggttaggtcggctgcctttaatcaataccaaagtggtccctaccacgatggaaaaactgtgcagtcggtttggctttttctgacgaacaaataagattcgtggccgacaggtgggggtccaccatgtgaaggcatcttcagactccaataatggagcaatgacgtaagggcttacgaaataagtaagggtagtttgggaaatgtccactcacccgtcagtctataaatacttagcccctccctcattgttaagggagcaaaatctcagagagatagtcctagagagagaaagagagcaagtagcctagaagtaggatccacatggagttatctcttctccgtccgacgactcaatcgcttcttccgtcgttttcgaagcccaatctccgattaaatgtttataagcctcttagactccgttgttcagtggccggtggaccaaccgtcggatcttcaaaaatcgaaggcggaggaggcaccaccatcacgacggattgtgtgattgtcggcggaggtattagtggtctttgcatcgctcaggcgcttgctactaagcatcctgatgctgctccgaatttaattgtgaccgaggctaaggatcgtgttggaggcaacattatcactcgtgaagagaatggttttctctgggaagaaggtcccaatagttttcaaccgtctgatcctatgctcactatggtggtagatagtggtttgaaggatgatttggtgttgggagatcctactgcgccaaggtttgtgttgtggaatgggaaattgaggccggttccatcgaagctaacagacttaccgttctttgatttgatgagtattggtgggaagattagagctggttttggtgcacttggcattcgaccgtcacctccaggtcgtgaagaatctgtggaggagtttgtacggcgtaacctcggtgatgaggtttttgagcgcctgattgaaccgttttgttcaggtgtttatgctggtgatccttcaaaactgagcatgaaagcagcgtttgggaaggtttggaaactagagcaaaatggtggaagcataataggtggtacttttaaggcaattcaggagaggaaaaacgctcccaaggcagaacgagacccgcgcctgccaaaaccacagggccaaacagttggttctttcaggaagggacttcgaatgttgccagaagcaatatctgcaagattaggtagcaaagttaagttgtcttggaagctcttaggtatcactaagctggagagcggaggatacaacttaacatatgagactccagatggtttagtttccgtgcagagcaaaagtgttgtaatgacggtgccatctcatgttgcaagcggtctcttgcgccctctttctgaatctgctgcaaatgcactctcaaaactatattacccaccagttgcagcagtatctatctcgtacccgaaagaagcaatccgaacagaatgtttgatagatggtgaactaaagggttttgggcaattgcatccacgcacgcaaggagttgaaacattaggaactatctacagctcctcactctttccaaatcgcgcaccgcccggaagaattttgctgttgaacatgattggcgggtctacaaacaccggaattctgtccaagtctgaaggtgagttagtggaagcagttgacagagatttgaggaaaatgctaattaagcctaattcgaccgatccacttaaattaggagttagggtatggcctcaagccattcctcagtttctagttggtcactttgatatccttgacacggctaaatcatctctaacgtcttcgggctacgaagggctatttttgggtggcaattacgtcgctggtgtagccttaggccggtgtgtagaaggcgcatatgaaaccgcgattgaggtcaacaacttcatgtcacggtacgcttacaagtaaatgtaaaacattaaatctcccagcttgcgtgagttttattaaatattttgagatatcaaacttcaatttcattttgactaaattactcacactggcggccgccaccgcggtggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

What is claimed is:

1. A nucleic acid sequence capable of driving expression in a plant cell, where said nucleic acid sequence comprises a nucleic acid sequence that is at least 99% identical to SEQ ID NO:2.

2. The nucleic acid sequence of claim 1, wherein the nucleic acid sequence is SEQ ID NO: 2.

3. The nucleic acid sequence of claim 1, wherein the plant cell is a monocot cell.

4. The nucleic acid sequence of claim 1, wherein the plant cell is a maize cell.

5. The nucleic acid sequence of claim 1, wherein the plant cell is a dicot cell.

6. The nucleic acid sequence of claim 1, wherein the plant cell is a tobacco cell or a soybean cell.

7. A method of expressing a heterologous gene comprising:

a) constructing an expression cassette comprising SEQ ID NO: 2 and a heterologous gene, wherein the expression cassette is functional in a plant, plant cell, or plant tissue; and b) creating a plant, plant cell, or plant tissue or portion thereof comprising the expression cassette, wherein the heterologous gene is expressed.

8. The method of claim 7, wherein the plant, plant cell, or plant tissue or portion thereof is a monocot.

9. The method of claim 8, wherein the plant, plant cell, or plant tissue or portion thereof is maize.

10. A plant, plant cell, or plant tissue or portion thereof comprising an expression cassette comprising SEQ ID NO: 2.

11. The plant, plant cell, or plant tissue or portion thereof of claim 10, wherein the plant, plant cell, or plant tissue is a monocot.

12. The plant, plant cell, or plant tissue or portion thereof of claim 10, wherein the plant, plant cell, or plant tissue is maize.

13. The plant, plant cell, or plant tissue or portion thereof of claim 10, wherein the plant, plant cell, or plant tissue is a dicot.

14. The plant, plant cell, or plant tissue or portion thereof of claim 10, wherein the plant, plant cell, or plant tissue is tobacco or soybean.

15. An expression cassette comprising SEQ ID NO: 2.

16. A plant, plant cell, or plant tissue or portion thereof made by the method of claim 7.

17. A progeny of the plant, plant cell, or plant tissue or portion thereof, of claim 16, wherein said progeny comprises SEQ ID NO:2.

18. Seed derived from the progeny of claim 17, wherein the seed comprises SEQ ID NO: 2.

19. Grain derived from the seed of claim 18, wherein the grain comprises SEQ ID NO: 2.

* * * * *